United States Patent 7,745,391 (HUMAN THROMBOSPONDIN POLYPEPTIDE) - sequence listing, part 138

SEQ ID NO: 368594 - DNA, 928 bp, Homo sapiens
  misc_feature (20)..(20): n is a, c, g, or t
aattcggcacgaggatgatntggaagaggagaaacaagagtcagaaaaattagcagcatccgtgatctgactctgggtaccagtgggttgttgagatttctgttccccactcactgcagagctgctgcctgccaatgccccctgttgggcagggccacctgtgctagtttaacctggggtctttcactcccggactgcttcttggatgtgagttttaagttgagcaaagcgggctcgccctgccggcggcgcggccatgctcatcacgctgtgctacctgtacctgtgggcgcgctggggtcgccggccggctgagctcgtgcgcgccacggtgcggcggctgcgtgcctcgcgctgttccttcaccttctgcggcgcggccgcggagcccccgggcgcccgcgtgtgcctgagccgtggcggccgcgtcttctgcgtcagcgacagccaggtgggcgggtcgggcgggcgggcgacccgggccccgcgagccggaagtgcccccgtccctgcgcctcgtccccgccgggagcccgggagttcgggagccccggagtggcgccctcagtgcggcctgtgcggcccgggaggggctgttgccccggggcccagagagaggccggaggtgcgggactcggaccacggacccggtcgcctcttcccggccagccgggcggtgctggacgcgtgactctaggcgcgcacctgtgaggacgtgagctgtggattgacagccggacgccagcagtgcccacctggggtcgcccccaacctcctctcccacacttcgagccggcgtttgggtgaccgtgaaccaggagagacagctgtggcgggccgggagcggtggcttatgcctgtaatccctgcactctgggaggcctaggaggaaggacagctttgagcccaggagatggagaccagcctg

SEQ ID NO: 368595 - DNA, 777 bp, Homo sapiens
gaccccctcacgaccacctcgccccaaggcgacctcgaagtgcccccaactccgccacttctcaggaaagagattgggagaatgcggcagaactccccggaggagcaggcccgctcctcaccgcgcccccgcagggagaagggaggaccacctctcccccagaccctagccaaacctgacactcgggaccctgggatgggacgatctcccaggtgccagctcagggagtccatgaaaagcttcaacgaatcgaatgagccccttccccagccataatacccagccgccagagatgagggaggctatcattatttacattgcccgtgcctggaagggaaactgaagttgcgcaggaacaatccgaggaactgggccttgaaccgaaattccgaactcggacccgaataggcccagacagaactccgacaccgccccctacggtgcggcacgagagggctaaggggcgggggcatgtgcaccggaagctgcctctgcccacaaccaagatggctgaggagagggcggaagtgtccgcacgtcgggcctccgaggcttctctttctccccatggctctcccctagagccagtgggacccttcaggaccctgggctggaaccaccaccactggtcctgtctcaagtgcacttagggggtggtggaggcagggacacctgagacacacctgtctccatttccagttccaggaccccaaagccatttgcccctgtgccttatacacgtgccaacctggaaataaaatgtcagccttttttata

SEQ ID NO: 368596 - DNA, 1822 bp, Homo sapiens
gaccccctcacgaccacctcgccccaaggcgacctcgaagtgcccccaactccgccacttctcaggaaagagattgggagaatgcggcagaactccccggaggagcaggcccgctcctcaccgcgcccccgcagggagaagggaggaccacctctcccccagaccctagccaaacctgacactcgggaccctgggatgggacgatctcccaggtgccagctcagggagtccatgaaaagcttcaacgaatcgaatgagccccttccccagccataatacccagccgccagagatgagggaggctatcattatttacattgcccgtgcctggaagggaaactgaagttgcgcaggaacaatccgaggaactgggccttgaaccgaaattccgaactcggacccgaataggcccagacagaactccgacaccgccccctacggtgcggcacgagagggctaaggggcgggggcatgtgcaccggaagctgcctctgcccacaaccaagatggctgaggagagggcggaagtgtccgcacgtcgggcctccgaggcttctctttctcccctggcggtccggctctcgatggtggcgtgacgggggcgggggtggcggcgcgttctcctcggttgggagggaaccagcccgcgaacccaggccgggaggggggttcggcctgggggggaagggactgacatgtctctcgaagaccccttttttgtagtccgaggcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcggtatagtggaagccaacccaggcaagttcaagctcccagccggggacctgcaggagagaaaggtgttcgtggagcggatgcgagaggcagtccaggaaatgaaggaccatatggtcagcccaacagccgtagcatttttggagaggaataacagagagatactcgcaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttggccaaagtatcccacatgacgagtgaccgccgacagtggtgtgccatcgccgtgctagtgggggtgcttctcctcgttctcatcttactattctctctctgaccccagccctccctggcaggctggtcccttaagcctggggagccaccaagcactttggagctggcctcgccccctaggaggagagggtccctcctgggtagctggagagtagagggtcccgcctggggagctgtccccatggctctcccctagagccagtgggacccttcaggaccctgggctggaaccaccaccactggtcctgtctcaagtgcacttagggggtggtggaggcagggacacctgagacacacctgtctccatttccagttccaggaccccaaagccatttgcccctgtgccttatacacgtgccaacctggaaataaaatgtcagccttttttataataaaaaaaaaaaaacccaggattatacg

SEQ ID NO: 368597 - DNA, 1966 bp, Homo sapiens
gaccccctcacgaccacctcgccccaaggcgacctcgaagtgcccccaactccgccacttctcaggaaagagattgggagaatgcggcagaactccccggaggagcaggcccgctcctcaccgcgcccccgcagggagaagggaggaccacctctcccccagaccctagccaaacctgacactcgggaccctgggatgggacgatctcccaggtgccagctcagggagtccatgaaaagcttcaacgaatcgaatgagccccttccccagccataatacccagccgccagagatgagggaggctatcattatttacattgcccgtgcctggaagggaaactgaagttgcgcaggaacaatccgaggaactgggccttgaaccgaaattccgaactcggacccgaataggcccagacagaactccgacaccgccccctacggtgcggcacgagagggctaaggggcgggggcatgtgcaccggaagctgcctctgcccacaaccaagatggctgaggagagggcggaagtgtccgcacgtcgggcctccgaggcttctctttctcccctggcggtccggctctcgatggtggcgtgacgggggcgggggtggcggcgcgttctcctcggttgggagggaaccagcccgcgaacccaggccgggaggggggttcggcctgggggggaagggactgacatgtctctcgaagaccccttttttgtagtccgaggcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcggtatagtggaagccaacccaggcaagttcaagctcccagccggggacctgcaggagagaaaggtgttcgtggagcggatgcgagaggcagtccaggaaatgaaggaccatatggtcagcccaacagccgtagcatttttggagaggaataacagagagatactcgcaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttggccaaagtatcccacatgacgagtgaccgccgacagtggtgtgccatcgccgtgctagtgggggtgcttctcctcgttctcatcttactattctctctctgaccccagccctccctggcaggctggtcccttaagcctggggagccaccaagcactttggagctggcctcgccccctaggaggagagggtccctcctgggtagctggagagtagagggtcccgcctggggagctgtccccatggctctcccctagagccagtgggacccttcaggaccctgggctggaaccaccaccactggtcctgtctcaagtgcacttagggggtggtggaggcagggacacctgagacacacctgtctccatttccagttccaggaccccaaagccatttgcccctgtgccttatacacgtgccaacctggaaataaaatgtcagccttttttataaaaaaaaaaaaaaacaaacaaacaaacaaaacaaagaagaaaaaaaaagaaacagaaaaaaagagacagaaaaaaagacaaggaaaaaaaacaaaaaagaagaacacaaaaaaagacaagaaacagcagacgaaaacacagagataacacagagtgacgagccgctgcgcggg

SEQ ID NO: 368598 - DNA, 2034 bp, Homo sapiens
gaccccctcacgaccacctcgccccaaggcgacctcgaagtgcccccaactccgccacttctcaggaaagagattgggagaatgcggcagaactccccggaggagcaggcccgctcctcaccgcgcccccgcagggagaagggaggaccacctctcccccagaccctagccaaacctgacactcgggaccctgggatgggacgatctcccaggtgccagctcagggagtccatgaaaagcttcaacgaatcgaatgagccccttccccagccataatacccagccgccagagatgagggaggctatcattatttacattgcccgtgcctggaagggaaactgaagttgcgcaggaacaatccgaggaactgggccttgaaccgaaattccgaactcggacccgaataggcccagacagaactccgacaccgccccctacggtgcggcacgagagggctaaggggcgggggcatgtgcaccggaagctgcctctgcccacaaccaagatggctgaggagagggcggaagtgtccgcacgtcgggcctccgaggcttctctttctcccctggcggtccggctctcgatggtggcgtgacgggggcgggggtggcggcgcgttctcctcggttgggagggaaccagcccgcgaacccaggccgggaggggggttcggcctgggggggaagggactgacatgtctctcgaagaccccttttttgtagtccgagggtgagtgacaacgacgggggagggcggagggtgctctgtacccaagccagccagtgcccgggtgccggccccagcgtgcccggcgggctgggcaaggccgtcggggtgcagagtgggaggcgcacgcaggggtatataggggtctccggagtcccccatgcgtttgggtttgcagtcgggggcagaggcaggcgggaggaccgcctgcccccagccgcgcccgccgtgcccctgcccgcagcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcggtatagtggaagccaacccaggcaagttcaagctcccagccggggacctgcaggagagaaaggtgttcgtggagcggatgcgagaggcagtccaggaaatgaaggaccatatggtcagcccaacagccgtagcatttttggagaggaataacagagagatactcgcaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttggccaaagtatcccacatgacgagtgaccgccgacagtggtgtgccatcgccgtgctagtgggggtgcttctcctcgttctcatcttactattctctctctgaccccagccctccctggcaggctggtcccttaagcctggggagccaccaagcactttggagctggcctcgccccctaggaggagagggtccctcctgggtagctggagagtagagggtcccgcctggggagctgtccccatggctctcccctagagccagtgggacccttcaggaccctgggctggaaccaccaccactggtcctgtctcaagtgcacttagggggtggtggaggcagggacacctgagacacacctgtctccatttccagttccaggaccccaaagccatttgcccctgtgccttatacacgtgccaacctggaaataaaatgtcagccttttttata

SEQ ID NO: 368599 - DNA, 1839 bp, Homo sapiens
gaccccctcacgaccacctcgccccaaggcgacctcgaagtgcccccaactccgccacttctcaggaaagagattgggagaatgcggcagaactccccggaggagcaggcccgctcctcaccgcgcccccgcagggagaagggaggaccacctctcccccagaccctagccaaacctgacactcgggaccctgggatgggacgatctcccaggtgccagctcagggagtccatgaaaagcttcaacgaatcgaatgagccccttccccagccataatacccagccgccagagatgagggaggctatcattatttacattgcccgtgcctggaagggaaactgaagttgcgcaggaacaatccgaggaactgggccttgaaccgaaattccgaactcggacccgaataggcccagacagaactccgacaccgccccctacggtgcggcacgagagggctaaggggcgggggcatgtgcaccggaagctgcctctgcccacaaccaagatggctgaggagagggcggaagtgtccgcacgtcgggcctccgaggcttctctttctcccctggcggtccggctctcgatggtggcgtgacgggggcgggggtggcggcgcgttctcctcggttgggagggaaccagcccgcgaacccaggccgggaggggtatataggggtctccggagtcccccatgcgtttgggtttgcagtcgggggcagaggcaggcgggaggaccgcctgcccccagccgcgcccgccgtgcccctgcccgcagcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcggtatagtggaagccaacccaggcaagttcaagctcccagccggggacctgcaggagagaaaggtgttcgtggagcggatgcgagaggcagtccaggaaatgaaggaccatatggtcagcccaacagccgtagcatttttggagaggaataacagagagatactcgcaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttggccaaagtatcccacatgacgagtgaccgccgacagtggtgtgccatcgccgtgctagtgggggtgcttctcctcgttctcatcttactattctctctctgaccccagccctccctggcaggctggtcccttaagcctggggagccaccaagcactttggagctggcctcgccccctaggaggagagggtccctcctgggtagctggagagtagagggtcccgcctggggagctgtccccatggctctcccctagagccagtgggacccttcaggaccctgggctggaaccaccaccactggtcctgtctcaagtgcacttagggggtggtggaggcagggacacctgagacacacctgtctccatttccagttccaggaccccaaagccatttgcccctgtgccttatacacgtgccaacctggaaataaaatgtcagccttttttata

SEQ ID NO: 368600 - DNA, 2168 bp, Homo sapiens
gaccccctcacgaccacctcgccccaaggcgacctcgaagtgcccccaactccgccacttctcaggaaagagattgggagaatgcggcagaactccccggaggagcaggcccgctcctcaccgcgcccccgcagggagaagggaggaccacctctcccccagaccctagccaaacctgacactcgggaccctgggatgggacgatctcccaggtgccagctcagggagtccatgaaaagcttcaacgaatcgaatgagccccttccccagccataatacccagccgccagagatgagggaggctatcattatttacattgcccgtgcctggaagggaaactgaagttgcgcaggaacaatccgaggaactgggccttgaaccgaaattccgaactcggacccgaataggcccagacagaactccgacaccgccccctacggtgcggcacgagagggctaaggggcgggggcatgtgcaccggaagctgcctctgcccacaaccaagatggctgaggagagggcggaagtgtccgcacgtcgggcctccgaggcttctctttctcccctggcggtccggctctcgatggtggcgtgacgggggcgggggtggcggcgcgttctcctcggttgggagggaaccagcccgcgaacccaggccgggaggggggttcggcctgggggggaagggactgacatgtctctcgaagaccccttttttgtagtccgagggtgagtgacaacgacgggggagggcggagggtgctctgtacccaagccagccagtgcccgggtgccggccccagcgtgcccggcgggctgggcaaggccgtcggggtgcagagtgggaggcgcacgcaggggtatataggggtctccggagtcccccatgcgtttgggtttgcagtcgggggcagaggcaggcgggaggaccgcctgcccccagccgcgcccgccgtgcccctgcccgcagcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcgatatcctggggctttgtggcagagggtggcatgggagagcccattgcggtggcagcccaccttcgggtagggctggacccctagggacggggatgatatctggctccggccttgacccttgactctcagcccacgtatagtggaagccaacccaggcaagttcaagctcccagccggggacctgcaggagagaaaggtgttcgtggagcggatgcgagaggcagtccaggaaatgaaggaccatatggtcagcccaacagccgtagcatttttggagaggaataacagagagatactcgcaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttggccaaagtatcccacatgacgagtgaccgccgacagtggtgtgccatcgccgtgctagtgggggtgcttctcctcgttctcatcttactattctctctctgaccccagccctccctggcaggctggtcccttaagcctggggagccaccaagcactttggagctggcctcgccccctaggaggagagggtccctcctgggtagctggagagtagagggtcccgcctggggagctgtccccatggctctcccctagagccagtgggacccttcaggaccctgggctggaaccaccaccactggtcctgtctcaagtgcacttagggggtggtggaggcagggacacctgagacacacctgtctccatttccagttccaggaccccaaagccatttgcccctgtgccttatacacgtgccaacctggaaataaaatgtcagccttttttata

SEQ ID NO: 368601 - DNA, 1319 bp, Homo sapiens
  misc_feature (5)..(5): n is a, c, g, or t
ggcgnaatttagagtatcggctaggtacgaggctgggtttgaatcggccgagggttctcctcggttgggagggaaccagcccgcgaacccaggccgggaggggggttcggcctgggggggaagggactgacatgtctctcgaagaccccttttttgtagtccgaggcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcggtatagtggaagccaacccaggcaagttcaagctcccagccggggacctgcaggagagaaaggtgttcgtggagcggatgcgagaggcagtccaggaaatgaaggaccatatggtcagcccaacagccgtagcatttttggagaggaataacagagagatactcgcaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttggccaaagtatcccacatgacgagtggtgagtcccctcaggggaggggtcagtcctggtgggggcaggttgtaggtggtaccctctccccgtgacccctgaccttctcgttcccagaccgccgacagtggtgtgccatcgccgtgctagtgggggtgcttctcctcgttctcatcttactattctctctctgaccccagccctccctggcaggctggtcccttaagcctggggagccaccaagcactttggagctggcctcgccccctaggaggagagggtccctcctgggtagctggagagtagagggtcccgcctggggagctgtccccatggctctcccctagagccagtgggacccttcaggaccctgggctggaaccaccaccactggtcctgtctcaagtgcacttagggggtggtggaggcagggacacctgagacacacctgtctccatttccagttccaggaccccaaagccatttgcccctgtgccttatacacgtgccaacctggaaataaaatgtcagccttttttata

SEQ ID NO: 368602 - DNA, 1635 bp, Homo sapiens
gaccccctcacgaccacctcgccccaaggcgacctcgaagtgcccccaactccgccacttctcaggaaagagattgggagaatgcggcagaactccccggaggagcaggcccgctcctcaccgcgcccccgcagggagaagggaggaccacctctcccccagaccctagccaaacctgacactcgggaccctgggatgggacgatctcccaggtgccagctcagggagtccatgaaaagcttcaacgaatcgaatgagccccttccccagccataatacccagccgccagagatgagggaggctatcattatttacattgcccgtgcctggaagggaaactgaagttgcgcaggaacaatccgaggaactgggccttgaaccgaaattccgaactcggacccgaataggcccagacagaactccgacaccgccccctacggtgcggcacgagagggctaaggggcgggggcatgtgcaccggaagctgcctctgcccacaaccaagatggctgaggagagggcggaagtgtccgcacgtcgggcctccgaggcttctctttctcccctggcggtccggctctcgatggtggcgtgacgggggcgggggtggcggcgcgttctcctcggttgggagggaaccagcccgcgaacccaggccgggaggggggttcggcctgggggggaagggactgacatgtctctcgaagaccccttttttgtagtccgaggcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcgatactcgcaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttggccaaagtatcccacatgacgagtgaccgccgacagtggtgtgccatcgccgtgctagtgggggtgcttctcctcgttctcatcttactattctctctctgaccccagccctccctggcaggctggtcccttaagcctggggagccaccaagcactttggagctggcctcgccccctaggaggagagggtccctcctgggtagctggagagtagagggtcccgcctggggagctgtccccatggctctcccctagagccagtgggacccttcaggaccctgggctggaaccaccaccactggtcctgtctcaagtgcacttagggggtggtggaggcagggacacctgagacacacctgtctccatttccagttccaggaccccaaagccatttgcccctgtgccttatacacgtgccaacctggaaataaaatgtcagccttttttata

SEQ ID NO: 368603 - DNA, 612 bp, Homo sapiens
agctcggtaccccgtccagctcttctcccacgcggccggacatgtgcttcagaacctggatgcgttggagaagagctggacgagcagggcatcatgctggatgccttcgcccaagagatggaccacacccagtcccgcatggacggggtcctcaggaagttggccaaagtatcccacatgacgagtgaccgccgacagtggtgtgccatcgccgtgctagtgggggtgcttctcctcgttctcatcttactattctctctctgaccccagccctccctggcaggctggtcccttaagcctggggagccaccaagcactttggagctggcctcgccccctaggaggagagggtccctcctgggtagctggagagtagagggtcccgcctggggagctgtccccatggctctcccctagagccagtgggacccttcaggaccctgggctggaaccaccaccactggtcctgtctcaagtgcacttagggggtggtggaggcagggacacctgagacacacctgtctccatttccagttccaggaccccaaagccatttgcccctgtgccttatacacgtgccaacctggaaataaaatgtcagccttttttata

SEQ ID NO: 368604 - DNA, 1793 bp, Homo sapiens
gaccccctcacgaccacctcgccccaaggcgacctcgaagtgcccccaactccgccacttctcaggaaagagattgggagaatgcggcagaactccccggaggagcaggcccgctcctcaccgcgcccccgcagggagaagggaggaccacctctcccccagaccctagccaaacctgacactcgggaccctgggatgggacgatctcccaggtgccagctcagggagtccatgaaaagcttcaacgaatcgaatgagccccttccccagccataatacccagccgccagagatgagggaggctatcattatttacattgcccgtgcctggaagggaaactgaagttgcgcaggaacaatccgaggaactgggccttgaaccgaaattccgaactcggacccgaataggcccagacagaactccgacaccgccccctacggtgcggcacgagagggctaaggggcgggggcatgtgcaccggaagctgcctctgcccacaaccaagatggctgaggagagggcggaagtgtccgcacgtcgggcctccgaggcttctctttctcccctggcggtccggctctcgatggtggcgtgacgggggcgggggtggcggcgcgttctcctcggttgggagggaaccagcccgcgaacccaggccgggaggggggttcggcctgggggggaagggactgacatgtctctcgaagaccccttttttgtagtccgaggcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcggtatagtggaagccaacccaggcaagttcaagctcccagccggggacctgcaggagagaaaggtgttcgtggagcggatgcgagaggcagtccaggaaatgaaggaccatatggtcagcccaacagccgtagcatttttggagaggaataacagagagatactcgcaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttggccaaagtatcccacatgacgagtgaccgccgacagtggtgtgccatcgccgtgctagtgggggtgcttctcctcgttctcatcttactattctctctctgaccccagccctccctggcaggctggtcccttaagcctggggagccaccaagcactttggagctggcctcgccccctaggaggagagggtccctcctgggtagctggagagtagagggtcccgcctggggagctgtccccatggctctcccctagagccagtgggacccttcaggaccctgggctggaaccaccaccactggtcctgtctcaagtgcacttagggggtggtggaggcagggacacctgagacacacctgtctccatttccagttccaggaccccaaagccatttgcccctgtgccttatacacgtgccaacctggaaataaaatgtcagccttttttata

SEQ ID NO: 368605 - DNA, 1229 bp, Homo sapiens
  misc_feature (5)..(5): n is a, c, g, or t
ggcgnaatttagagtatcggctaggtacgaggctgggtttgaatcggccgagggttctcctcggttgggagggaaccagcccgcgaacccaggccgggaggggggttcggcctgggggggaagggactgacatgtctctcgaagaccccttttttgtagtccgaggcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcggtatagtggaagccaacccaggcaagttcaagctcccagccggggacctgcaggagagaaaggtgttcgtggagcggatgcgagaggcagtccaggaaatgaaggaccatatggtcagcccaacagccgtagcatttttggagaggaataacagagagatactcgcaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttggccaaagtatcccacatgacgagtgaccgccgacagtggtgtgccatcgccgtgctagtgggggtgcttctcctcgttctcatcttactattctctctctgaccccagccctccctggcaggctggtcccttaagcctggggagccaccaagcactttggagctggcctcgccccctaggaggagagggtccctcctgggtagctggagagtagagggtcccgcctggggagctgtccccatggctctcccctagagccagtgggacccttcaggaccctgggctggaaccaccaccactggtcctgtctcaagtgcacttagggggtggtggaggcagggacacctgagacacacctgtctccatttccagttccaggaccccaaagccatttgcccctgtgccttatacacgtgccaacctggaaataaaatgtcagccttttttata

SEQ ID NO: 368606 - DNA, 1883 bp, Homo sapiens
gaccccctcacgaccacctcgccccaaggcgacctcgaagtgcccccaactccgccacttctcaggaaagagattgggagaatgcggcagaactccccggaggagcaggcccgctcctcaccgcgcccccgcagggagaagggaggaccacctctcccccagaccctagccaaacctgacactcgggaccctgggatgggacgatctcccaggtgccagctcagggagtccatgaaaagcttcaacgaatcgaatgagccccttccccagccataatacccagccgccagagatgagggaggctatcattatttacattgcccgtgcctggaagggaaactgaagttgcgcaggaacaatccgaggaactgggccttgaaccgaaattccgaactcggacccgaataggcccagacagaactccgacaccgccccctacggtgcggcacgagagggctaaggggcgggggcatgtgcaccggaagctgcctctgcccacaaccaagatggctgaggagagggcggaagtgtccgcacgtcgggcctccgaggcttctctttctcccctggcggtccggctctcgatggtggcgtgacgggggcgggggtggcggcgcgttctcctcggttgggagggaaccagcccgcgaacccaggccgggaggggggttcggcctgggggggaagggactgacatgtctctcgaagaccccttttttgtagtccgaggcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcggtatagtggaagccaacccaggcaagttcaagctcccagccggggacctgcaggagagaaaggtgttcgtggagcggatgcgagaggcagtccaggaaatgaaggaccatatggtcagcccaacagccgtagcatttttggagaggaataacagagagatactcgcaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttggccaaagtatcccacatgacgagtggtgagtcccctcaggggaggggtcagtcctggtgggggcaggttgtaggtggtaccctctccccgtgacccctgaccttctcgttcccagaccgccgacagtggtgtgccatcgccgtgctagtgggggtgcttctcctcgttctcatcttactattctctctctgaccccagccctccctggcaggctggtcccttaagcctggggagccaccaagcactttggagctggcctcgccccctaggaggagagggtccctcctgggtagctggagagtagagggtcccgcctggggagctgtccccatggctctcccctagagccagtgggacccttcaggaccctgggctggaaccaccaccactggtcctgtctcaagtgcacttagggggtggtggaggcagggacacctgagacacacctgtctccatttccagttccaggaccccaaagccatttgcccctgtgccttatacacgtgccaacctggaaataaaatgtcagccttttttata

SEQ ID NO: 368607 - DNA, 1710 bp, Homo sapiens
gaccccctcacgaccacctcgccccaaggcgacctcgaagtgcccccaactccgccacttctcaggaaagagattgggagaatgcggcagaactccccggaggagcaggcccgctcctcaccgcgcccccgcagggagaagggaggaccacctctcccccagaccctagccaaacctgacactcgggaccctgggatgggacgatctcccaggtgccagctcagggagtccatgaaaagcttcaacgaatcgaatgagccccttccccagccataatacccagccgccagagatgagggaggctatcattatttacattgcccgtgcctggaagggaaactgaagttgcgcaggaacaatccgaggaactgggccttgaaccgaaattccgaactcggacccgaataggcccagacagaactccgacaccgccccctacggtgcggcacgagagggctaaggggcgggggcatgtgcaccggaagctgcctctgcccacaaccaagatggctgaggagagggcggaagtgtccgcacgtcgggcctccgaggcttctctttctcccctggcggtccggctctcgatggtggcgtgacgggggcgggggtggcggcgcgttctcctcggttgggagggaaccagcccgcgaacccaggccgggaggggggttcggcctgggggggaagggactgacatgtctctcgaagaccccttttttgtagtccgaggcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcggtatagtggaagccaacccaggcaagttcaagctcccagccggggacctgcaggagagaaaggtgttcgtggagcggatgcgagaggcagtccaggaaatgaaggaccatatggtcagcccaacagccgtagcatttttggagaggaataacagagagatactcgcaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttggccaaagtatcccacatgacgagtgccctccctggcaggctggtcccttaagcctggggagccaccaagcactttggagctggcctcgccccctaggaggagagggtccctcctgggtagctggagagtagagggtcccgcctggggagctgtccccatggctctcccctagagccagtgggacccttcaggaccctgggctggaaccaccaccactggtcctgtctcaagtgcacttagggggtggtggaggcagggacacctgagacacacctgtctccatttccagttccaggaccccaaagccatttgcccctgtgccttatacacgtgccaacctggaaataaaatgtcagccttttttata

SEQ ID NO: 368608 - DNA, 1964 bp, Homo sapiens
gaccccctcacgaccacctcgccccaaggcgacctcgaagtgcccccaactccgccacttctcaggaaagagattgggagaatgcggcagaactccccggaggagcaggcccgctcctcaccgcgcccccgcagggagaagggaggaccacctctcccccagaccctagccaaacctgacactcgggaccctgggatgggacgatctcccaggtgccagctcagggagtccatgaaaagcttcaacgaatcgaatgagccccttccccagccataatacccagccgccagagatgagggaggctatcattatttacattgcccgtgcctggaagggaaactgaagttgcgcaggaacaatccgaggaactgggccttgaaccgaaattccgaactcggacccgaataggcccagacagaactccgacaccgccccctacggtgcggcacgagagggctaaggggcgggggcatgtgcaccggaagctgcctctgcccacaaccaagatggctgaggagagggcggaagtgtccgcacgtcgggcctccgaggcttctctttctcccctggcggtccggctctcgatggtggcgtgacgggggcgggggtggcggcgcgttctcctcggttgggagggaaccagcccgcgaacccaggccgggaggggggttcggcctgggggggaagggactgacatgtctctcgaagaccccttttttgtagtccgagggtgagtgacaacgacgggggagggcggagggtgctctgtacccaagccagccagtgcccgggtgccggccccagcgtgcccggcgggctgggcaaggccgtcggggtgcagagtgggaggcgcacgcaggggtatataggggtctccggagtcccccatgcgtttgggtttgcagtcgggggcagaggcaggcgggaggaccgcctgcccccagccgcgcccgccgtgcccctgcccgcagcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcggtatagtggaagccaacccaggcaagttcaagctcccagccggggacctgcaggagagaaaggtgttcgtggagcggatgcgagaggcagtccaggaaatgaaggaccatatggtcagcccaacagccgtagcatttttggagaggaataacagagagatactcgcaggcaagccagctgcccagaagtcacccagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttggccaaagtatcccacatgacgagtgaccgccgacagtggtgtgccatcgccgtgctagtgggggtgcttctcctcgttctcatcttactattctctctctgaccccagccctccctggcaggctggtcccttaagcctggggagccaccaagcactttggagctggcctcgccccctaggaggagagggtccctcctgggtagctggagagtagagggtcccgcctggggagctgtccccatggctctcccctagagccagtgggacccttcaggaccctgggctggaaccaccaccactggtcctgtctcaagtgcacttagggggtggtggaggcagggacacctgagacacacctgtctccatttccagttccaggaccccaaagccatttgcccctgtgccttatacacgtgccaacctggaaataaaatgtcagccttttttata

SEQ ID NO: 368609 - DNA, 1446 bp, Homo sapiens
gaccccctcacgaccacctcgccccaaggcgacctcgaagtgcccccaactccgccacttctcaggaaagagattgggagaatgcggcagaactccccggaggagcaggcccgctcctcaccgcgcccccgcagggagaagggaggaccacctctcccccagaccctagccaaacctgacactcgggaccctgggatgggacgatctcccaggtgccagctcagggagtccatgaaaagcttcaacgaatcgaatgagccccttccccagccataatacccagccgccagagatgagggaggctatcattatttacattgcccgtgcctggaagggaaactgaagttgcgcaggaacaatccgaggaactgggccttgaaccgaaattccgaactcggacccgaataggcccagacagaactccgacaccgccccctacggtgcggcacgagagggctaaggggcgggggcatgtgcaccggaagctgcctctgcccacaaccaagatggctgaggagagggcggaagtgtccgcacgtcgggcctccgaggcttctctttctcccctggcggtccggctctcgatggtggcgtgacgggggcgggggtggcggcgcgttctcctcggttgggagggaaccagcccgcgaacccaggccgggaggggggttcggcctgggggggaagggactgacatgtctctcgaagaccccttttttgtagtccgaggcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcggtatagtggaagccaacccaggcaagttcaagctcccagccggggacctgcaggagagaaaggtgttcgtggagcggatgcgagaggcagtccaggaaatgaaggaccatatggtcagcccaacagccgtagcatttttggagaggaataacagagagatactcgcaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttggccaaagtatcccacatgacgagtgttccaggaccccaaagccatttgcccctgtgccttatacacgtgccaacctggaaataaaatgtcagccttttttata

SEQ ID NO: 368610 - DNA, 1540 bp, Homo sapiens
gaccccctcacgaccacctcgccccaaggcgacctcgaagtgcccccaactccgccacttctcaggaaagagattgggagaatgcggcagaactccccggaggagcaggcccgctcctcaccgcgcccccgcagggagaagggaggaccacctctcccccagaccctagccaaacctgacactcgggaccctgggatgggacgatctcccaggtgccagctcagggagtccatgaaaagcttcaacgaatcgaatgagccccttccccagccataatacccagccgccagagatgagggaggctatcattatttacattgcccgtgcctggaagggaaactgaagttgcgcaggaacaatccgaggaactgggccttgaaccgaaattccgaactcggacccgaataggcccagacagaactccgacaccgccccctacggtgcggcacgagagggctaaggggcgggggcatgtgcaccggaagctgcctctgcccacaaccaagatggctgaggagagggcggaagtgtccgcacgtcgggcctccgaggcttctctttctcccctggcggtccggctctcgatggtggcgtgacgggggcgggggtggcggcgcgttctcctcggttgggagggaaccagcccgcgaacccaggccgggaggggggttcggcctgggggggaagggactgacatgtctctcgaagaccccttttttgtagtccgagggtgagtgacaacgacgggggagggcggagggtgctctgtacccaagccagccagtgcccgggtgccggccccagcgtgcccggcgggctgggcaaggccgtcggggtgcagagtgggaggcgcacgcaggggtatataggggtctccggagtcccccatgcgtttgggtttgcagtcgggggcagaggcaggcgggaggaccgcctgcccccagccgcgcccgccgtgcccctgcccgcagcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcggtatagtggaagccaacccaggcaagttcaagctcccagccggggacctgcaggagagaaaggtgttcgtggagcggatgcgagaggcagtccaggaaatgaaggaccatatggtcagcccaacagccgtagcatttttggagaggaataacagagagagtagagggtcccgcctggggagctgtccccatggctctcccctagagccagtgggacccttcaggaccctgggctggaaccaccaccactggtcctgtctcaagtgcacttagggggtggtggaggcagggacacctgagacacacctgtctccatttccagttccaggaccccaaagccatttgcccctgtgccttatacacgtgccaacctggaaataaaatgtcagccttttttata

SEQ ID NO: 368611 - DNA, 432 bp, Homo sapiens
ctaaatatacaaatcctccgaaatatataaaaatgagacctactgggcagctaaaacagtacaaccctacaaagaacaagacatgattttggccataaaacctactagaaaacccaaggattttgtataatgtgaactaagcatacaaatatagaaagagatttttatttcttgccaccacatttcttattgagaagaaaataatcggtattggcaaaatggtccatgaagactcctatgaaagcacagaaagtgctagatgatgatgaaattagaataaagtgggacttggaaatgttttaaaaaggggaacacattaaccgaattatttggaatgctagaatggaagtgtcctacaaataattcaaaggtcattacatctgtctttagaatgtaccaatcctttttgcaataaaattaacaattaattcc

SEQ ID NO: 368612 - DNA, 487 bp, Homo sapiens
gaggaccagggcatgtgcagggatgaccaccttctccctgggacctgaacagggcagagaaatgggaagctcgggtgcaaagggagtggggaagatgggtccgggcttacagtactgaacccaggaatgacaataactgtgtgtgttgctgcagtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttcaga

SEQ ID NO: 368613 - DNA, 299 bp, Homo sapiens
gcggccgcctactactactactgctcgaattcaagcttctaacgatgtacggggatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttcaga

SEQ ID NO: 368614 - DNA, 354 bp, Homo sapiens
ggcgctgcagggtcatgggcccgcccagctcgtagttgtgtctgcacatcctgtccggcactgcccgcttctcctccaggatgtccttctggctgttccagtactccgcatcaggccgccccagctccgtcaccgcccggaactcccccacgtcgctgtcgaagcgcacgaactcctcccggttgtagatgtatctctccaggaagcgctgtgtcccattaaacgcgtagcattcctgccgtccctggaaaaggtactggagtggccctgccctggaccacagatgtgagcagcaccatcagtaacgccgtcagagccactgtccggggggccgcagaaacctgcgaaccatca

SEQ ID NO: 368615 - DNA, 1525 bp, Homo sapiens
ggcgctgcagggtcatgggcccgcccagctcgtagttgtgtctgcacatcctgtccggcactgcccgcttctcctccaggatgtccttctggctgttccagtactccgcatcaggccgccccagctccgtcaccgcccggaactcccccacgtcgctgtcgaagcgcacgaactcctcccggttgtagatgtatctctccaggaagcgctgtgtcccattaaacgcgtagcattcctgccgtccctggaaaaggtagtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttcaga

SEQ ID NO: 368616 - DNA, 1258 bp, Homo sapiens
ctctctctctctctctctctctctctctctctctctcctcgtgccgaattcggcacgagtgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttcaga

SEQ ID NO: 368617 - DNA, 1944 bp, Homo sapiens
ggcgctgcagggtcatgggcccgcccagctcgtagttgtgtctgcacatcctgtccggcactgcccgcttctcctccaggatgtccttctggctgttccagtactccgcatcaggccgccccagctccgtcaccgcccggaactcccccacgtcgctgtcgaagcgcacgaactcctcccggttgtagatgtatctctccaggaagcgctgtgtcccattaaacgcgtagcattcctgccgtccctggaaaaggtacaccttccagcgtcctctttacccagcaacagagaatgtcagctctatgatttctctgataggtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttcagaaaaaaaaaaaaaaaaaaaaaaaaaaaacctgtgtgggccgcgacttgggcccttaaaaaaagtttctaaaacgcactccttttgggcgcgccggggccccatagagggtaaaggtagaccactggcgacaaacaggggtcccaaagggaaaacccgtggggacaaagtgacaataggcagcgtggggtttcttcaccccgatgatacaaaaagggccccgggggggagcaacacagaggtcgtgttgtgagaccaaaatcccaagaaggggacactcagggaagggcccaaaacggggcgactatatcataagagggaggcgtcccaagcgaaagccccagaattcaaatatcgccg

SEQ ID NO: 368618 - DNA, 1609 bp, Homo sapiens
ggcgctgcagggtcatgggcccgcccagctcgtagttgtgtctgcacatcctgtccggcactgcccgcttctcctccaggatgtccttctggctgttccagtactccgcatcaggccgccccagctccgtcaccgcccggaactcccccacgtcgctgtcgaagcgcacgaactcctcccggttgtagatgtatctctccaggaagcgctgtgtcccattaaacgcgtagcattcctgccgtccctggaaaaggtacaccttccagcgtcctctttacccagcaacagagaatgtcagctctatgatttctctgataggtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttcagacagagcggggaaaaaaaaaaca

SEQ ID NO: 368619 - DNA, 1529 bp, Homo sapiens
ggcgctgcagggtcatgggcccgcccagctcgtagttgtgtctgcacatcctgtccggcactgcccgcttctcctccaggatgtccttctggctgttccagtactccgcatcaggccgccccagctccgtcaccgcccggaactcccccacgtcgctgtcgaagcgcacgaactcctcccggttgtagatgtatctctccaggaagcgctgtgtcccattaaacgcgtagcattcctgccgtccctggaaaaggtacaccttccagcgtcctctttacccagcaacagagaatgtcagctctatgatttctctgataggtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgacaaaatatctgaacagaagaggacttaggagagatctgaactccagctgccctacaaactccatctcagcttttcttctcacttcacattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttcaga

SEQ ID NO: 368620 - DNA, 1437 bp, Homo sapiens
ggcgctgcagggtcatgggcccgcccagctcgtagttgtgtctgcacatcctgtccggcactgcccgcttctcctccaggatgtccttctggctgttccagtactccgcatcaggccgccccagctccgtcaccgcccggaactcccccacgtcgctgtcgaagcgcacgaactcctcccggttgtagatgtatctctccaggaagcgctgtgtcccattaaacgcgtagcattcctgccgtccctggaaaaggtagtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgagatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttcaga

SEQ ID NO: 368621 - DNA, 1626 bp, Homo sapiens
ggcgctgcagggtcatgggcccgcccagctcgtagttgtgtctgcacatcctgtccggcactgcccgcttctcctccaggatgtccttctggctgttccagtactccgcatcaggccgccccagctccgtcaccgcccggaactcccccacgtcgctgtcgaagcgcacgaactcctcccggttgtagatgtatctctccaggaagcgctgtgtcccattaaacgcgtagcattcctgccgtccctggaaaaggtacaccttccagcgtcctctttacccagcaacagagaatgtcagctctatgatttctctgataggtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaagggtgggaatgtaaagaggaggccctaggatttgtagaatgtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttcaga

SEQ ID NO: 368622 - DNA, 1263 bp, Homo sapiens
ggcgctgcagggtcatgggcccgcccagctcgtagttgtgtctgcacatcctgtccggcactgcccgcttctcctccaggatgtccttctggctgttccagtactccgcatcaggccgccccagctccgtcaccgcccggaactcccccacgtcgctgtcgaagcgcacgaactcctcccggttgtagatgtatctctccaggaagcgctgtgtcccattaaacgcgtagcattcctgccgtccctggaaaaggtatcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgtgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttcaga

SEQ ID NO: 368623 - DNA, 509 bp, Homo sapiens
  misc_feature (31)..(32): n is a, c, g, or t
gaaatactgaagtatttattggtcttagggnnttctcgggaaggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttcaga

SEQ ID NO: 368624 - DNA, 1532 bp, Homo sapiens
ggcgctgcagggtcatgggcccgcccagctcgtagttgtgtctgcacatcctgtccggcactgcccgcttctcctccaggatgtccttctggctgttccagtactccgcatcaggccgccccagctccgtcaccgcccggaactcccccacgtcgctgtcgaagcgcacgaactcctcccggttgtagatgtatctctccaggaagcgctgtgtcccattaaacgcgtagcattcctgccgtccctggaaaaggtacaccttccagcgtcctctttacccagcaacagagaatgtcagctctatgatttctctgataggtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggtgctgggcctagtcggcatcatcgtgggcaccgtcctcatcataaagtctctgcgttctggccatgacccccgggcccaggggaccctgtgaaatactgtaaagggtgggaatgtaaagaggaggccctaggatttgtagaatgtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttcaga

SEQ ID NO: 368625 - DNA, 1183 bp, Homo sapiens
ggcgctgcagggtcatgggcccgcccagctcgtagttgtgtctgcacatcctgtccggcactgcccgcttctcctccaggatgtccttctggctgttccagtactccgcatcaggccgccccagctccgtcaccgcccggaactcccccacgtcgctgtcgaagcgcacgaactcctcccggttgtagatgtatctctccaggaagcgctgtgtcccattaaacgcgtagcattcctgccgtccctggaaaaggtagtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattactgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttcaga

SEQ ID NO: 368626 - DNA, 838 bp, Homo sapiens
ggcgctgcagggtcatgggcccgcccagctcgtagttgtgtctgcacatcctgtccggcactgcccgcttctcctccaggatgtccttctggctgttccagtactccgcatcaggccgccccagctccgtcaccgcccggaactcccccacgtcgctgtcgaagcgcacgaactcctcccggttgtagatgtatctctccaggaagcgctgtgtcccattaaacgcgtagcattcctgccgtccctggaaaaggtagtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggattgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttcaga

SEQ ID NO: 368627 - DNA, 257 bp, Homo sapiens
tccttcctttgacctcttaccttcttcctttttatattcataagtctttattcattctctagctttgaccacttgcatattcaaactgacattttgtcgtgtttttctctactgtctttatgcagcggaccatgtgtcaacttatgccgcgtttgtacagacgcatagaccaacaggggagtttatgtttgaatttgatgaagatgagatgttctatgtggatctggacaagaaggagaccgtctggcatctggagg

SEQ ID NO: 368628 - DNA, 428 bp, Homo sapiens
atcctgtccggcactgcccgcttctcctccaggatgtccttctggctgttccagtactccgcatcaggccgccccagctccgtcaccgcccggaactcccccacgtcgctgtcgaagcgcacgaactcctcccggttgtagatgtatctctccaggaagcgctgtgtcccattaaacgcgtagcattcctgccgtccctggaaaaggtaattctctgcggggagggggcggacatgagcggaggcgccactctcatctaatcctctttctccctctctctctcaatattaacgattcttcccaaatcttcccacccagggctggattttaaaataggagttttcctagtaccgagttctgtggtcctaagcgggtcgcagagcctctccaggcctgttttctcaccacgcagagagagaatttactga

SEQ ID NO: 368629 - DNA, 1587 bp, Homo sapiens
ggcgctgcagggtcatgggcccgcccagctcgtagttgtgtctgcacatcctgtccggcactgcccgcttctcctccaggatgtccttctggctgttccagtactccgcatcaggccgccccagctccgtcaccgcccggaactcccccacgtcgctgtcgaagcgcacgaactcctcccggttgtagatgtatctctccaggaagcgctgtgtcccattaaacgcgtagcattcctgccgtccctggaaaaggtacaccttccagcgtcctctttacccagcaacagagaatgtcagctctatgatttctctgataggtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttcaga

SEQ ID NO: 368630 - DNA, 1293 bp, Homo sapiens
tgaacattcgtgtccgccttgatggccccagctcctcggagactcagcaggaaagccaaggagagggctctcaagatcacagctctgatatgagtgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttcaga

SEQ ID NO: 368631 - DNA, 1887 bp, Homo sapiens
ggcgctgcagggtcatgggcccgcccagctcgtagttgtgtctgcacatcctgtccggcactgcccgcttctcctccaggatgtccttctggctgttccagtactccgcatcaggccgccccagctccgtcaccgcccggaactcccccacgtcgctgtcgaagcgcacgaactcctcccggttgtagatgtatctctccaggaagcgctgtgtcccattaaacgcgtagcattcctgccgtccctggaaaaggtacaccttccagcgtcctctttacccagcaacagagaatgtcagctctatgatttctctgataggtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttcagaaaaaaaaaaaaaaaaaaaaaaaaaaaaattttgggggggccgggccccgaaaagtttttaaaacctttggtgggggggggggccccataagtgtaaggtggaccattggcgccaaacgtggttactcaaggaaaacccggcgtcctcaaaataacgtgcggtcggattctccccccatttaaaaaaagccccggggggacaccggagtctttcggaaccaatcccagtaggaggtcccaaaggcacctgacggggattcataaaccagggggtccaagcaaattccaatatcaatcaggc

SEQ ID NO: 368632 - DNA, 1496 bp, Homo sapiens
ggcgctgcagggtcatgggcccgcccagctcgtagttgtgtctgcacatcctgtccggcactgcccgcttctcctccaggatgtccttctggctgttccagtactccgcatcaggccgccccagctccgtcaccgcccggaactcccccacgtcgctgtcgaagcgcacgaactcctcccggttgtagatgtatctctccaggaagcgctgtgtcccattaaacgcgtagcattcctgccgtccctggaaaaggtacaccttccagcgtcctctttacccagcaacagagaatgtcagctctatgatttctctgataggtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgaataaatgttgacactttgatagcactgaaaaaaaaaaaa

SEQ ID NO: 368633 - DNA, 2238 bp, Homo sapiens
ggcgctgcagggtcatgggcccgcccagctcgtagttgtgtctgcacatcctgtccggcactgcccgcttctcctccaggatgtccttctggctgttccagtactccgcatcaggccgccccagctccgtcaccgcccggaactcccccacgtcgctgtcgaagcgcacgaactcctcccggttgtagatgtatctctccaggaagcgctgtgtcccattaaacgcgtagcattcctgccgtccctggaaaaggtacaccttccagcgtcctctttacccagcaacagagaatgtcagctctatgatttctctgataggtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaagggtgggaatgtaaagaggaggccctaggatttgtagaatgtaaggaagggaggaaaaattcaatctgataagtgttcattgatcttctaatgggttaaaagcattcagccacataacaacaacaacaccgataactaactgagtagttaatatggtcaggcgctattctgaggatttacatttattaactcactttattctcacacatagtctttgaggtaggtactattattttcactatttcacatgagagatacttacatctttttacatacacagagactttaagcactttgatcaagttcccacagctatgaagtagtagggctagcttccaatccagaaagtctggatccaagactgtttatccactgtcctattcaccctattttgtgaaggaaaagaccaagttcaaattctccagagtccattgccaaataatggagtcagatctatatttctatacataattacaacacagtgtggtgggtgcctgtaactacttactgtctctacttggactcattccatggcaatgttcacacaaaaaatgcccctccagagatcttacaggtttctatttatcataacactcaccatgctttatatttttatatgttttgggaattctcttagcattagacagtgaacttccatgcagatgaccacatctaattcattattattattgttattcatgctggacctcaggtacaaaaggttaagaacttctcagttcattatatgatcatcattggtgcctccgagctctctctctctcccttgatttatttggtcccttttatctccagtccttactcccatatctaacctcttacccctacctcataggtaaacattttaatgaatttgatgtttccttttatttgcatagatcctctgtaatatgtagtagtgtccagtgtacatgtatttttaattaaccaaaatggcattaaattatagatctaaaaaaaacatccag

SEQ ID NO: 368634 - DNA, 1467 bp, Homo sapiens
ggcgctgcagggtcatgggcccgcccagctcgtagttgtgtctgcacatcctgtccggcactgcccgcttctcctccaggatgtccttctggctgttccagtactccgcatcaggccgccccagctccgtcaccgcccggaactcccccacgtcgctgtcgaagcgcacgaactcctcccggttgtagatgtatctctccaggaagcgctgtgtcccattaaacgcgtagcattcctgccgtccctggaaaaggtagtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgcctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttcaga

SEQ ID NO: 368635 - DNA, 1246 bp, Homo sapiens
ggcgctgcagggtcatgggcccgcccagctcgtagttgtgtctgcacatcctgtccggcactgcccgcttctcctccaggatgtccttctggctgttccagtactccgcatcaggccgccccagctccgtcaccgcccggaactcccccacgtcgctgtcgaagcgcacgaactcctcccggttgtagatgtatctctccaggaagcgctgtgtcccattaaacgcgtagcattcctgccgtccctggaaaaggtacaccttccagcgtcctctttacccagcaacagagaatgtcagctctatgatttctctgataggtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtggcacgcctcctaagttctgcgtctggctgcccgggccgggccctgtgatcctgtcggtgcctttgcgaagt

SEQ ID NO: 368636 - DNA, 1007 bp, Homo sapiens
tgaacattcgtgtccgccttgatggccccagctcctcggagactcagcaggaaagccaaggagagggctctcaagatcacagctctgatatgagtgcctccactcggcctcagttcctcatcactgttcctgtgctcacagtcatcaattatagaccccattctataccaacacctattctgatttttcggtcaccctgaagtttatattcttatcctaccaggcttcggaataatctcccatatgtaacttactactccggaaaaaaagaaccattggatacataggtatggtctgagctatgatatcaatggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggattcatctttcttttcaccgtaggtggcctgactggcatgtattagcaaactcatcactagacatcgtactacacgacacgtactacgttgtagctcacttccactatgtcctatcaataggagctgtattgccatcataggaggcttcattcactgatttcccctattctcaggctacaccctagacaaactacgccaaaatccatttcactatcatattcatccggcgtaggatctaacttttcttcccacaacactttctccggctatccggaatgcccgacgttactcggactacccgatgcatacaccaatggaaaatctataatcttggaagatcattcattctcttacagcaggaaaattaataatttccgattgggaagccttgttctaaagaagcctatagttgaaaacccctaaccggggggtatttgtgtcgccccctcaaattgaagccgtattattaaaagagggtgcccgggttgccggcccgtttaaaaaag

SEQ ID NO: 368637 - DNA, 533 bp, Homo sapiens
agctgaggcagaattgcttgaatgtgggaggcaaaggttgcagagccgagattacgccactgcactccagcctgggcgacaagagtgaaacttcatctcaaaacaaaaaaataaataaaacagtacagtaggtgaagggtaagtcttagaaaactgggctcattgtccactgtccctatctggccctgaatttggcatctatttcttactgtccaaaaaaagcaaaactgcagtcagcacctacaaacaaaccaagatgaattaaaagctactttctttctcttttgctcattcctttttcttgaggaataagagcccagaatagaggaagacagcttagaagaaaagagaaaaaggcctgaggagggccttaccaaaagactaaaagcagaattggtttactagtctaaaatcaccatcctcaaaattaagtctttaaaaaaatttctgacggtaggagatcaaggcaggcggatcactcgaagctcaggagtttgagaccagcctgggcaatgtggagaaaccgcatctct

SEQ ID NO: 368638 - DNA, 304 bp, Homo sapiens
gacagggtagttaagacacaatgaaacgctgtgggagaagtatatatgtgcgccttctcattaggaatgggctattatttttcggttgaggtatactgtgggcaagaggtggaaaaaactacctcctcgttggtgggagttgtggctggtgctttacaattttctggagacagggtattcattatgagctgatgtgagcaaagcagtccctcagaacagcactgagaaggaaagaccaagtaagagcaacaggtggcattcagggtggggctctcaagcctggagcatttggaactatgaggct

SEQ ID NO: 368639 - DNA, 451 bp, Homo sapiens
ttccgcctcttaataccaccacagtggagattaagtttcaatgtgaattttgtaggggacacacgttcagactggtgctctgcctctgcccctcgcccccaaaaagtttatgtccttttcacatacaaatacattcattccattccagtagctccagaagtcttaacttgttctagcaccagctcaaaagtctaaagttgagtctcatctaaacatcatttcaatcagatacggtgagactcaaagatacgcttcatcctgtggcagatttctctctagctgtgaacctgtgaagtcaaacaagttacctgctttcaaaacacagtgtctacactgttggtgggaatgtaaattattaatagtacagccactgtggagaacagtatgaggttcctcagaaaactaaaaatagattaccatgtgatccagtaattccactactgagtatata

SEQ ID NO: 368640 - DNA, 1377 bp, Homo sapiens
aaaaaaaaaaaaaaaaaaaaaaaaaaaaaggtttttgaagatggcggccctcaaggctctggtgtccggctgtgggcggcttctccgtgggctactagcgggcccggcagcgaccagctggtctcggcttccagctcgcgggttcagggaagtggtggagacccaagaagggaagacaactataattgaaggccgtatcacagcgactcccaaggagagtccaaatcctcctaacccctctggccagtgccccatctgccgttggaacctgaagcacaagtataactatgacgatgttctgctgcttagccagttcatccggcctcatggaggcatgctgccccgaaagatcacaggcctatgccaggaagaacaccgcaagatcgaggagtgtgtgaagatggcccaccgagcaggtctattaccaaatcacaggcctcggcttcctgaaggagttgttccgaagagcaaaccccaactcaaccggtacctgacgcgctgggctcctggctccgtcaagcccatctacaaggacaatgtctgctactcaagaacaccttggaagctgtatcactgacagagagcagtgcttccagagttcctcctgcacctgtgctggggagtaggaggcccactcacaagcccttggccacaactatactcctgtcccaccccaccacgatggcctggtccctccaacatgcatggacaggggacagtgggactaacttcagtacccttggcctgcacagtagcaatgctgggagctagaggcaggcagggcagttgggtcccttgccagctgctatggggcttaggccatgctcagtgctggggacaggagttttgcccaacgcagtgtcataaactgggttcatgggcttacccattgggtgtgcgctcactgcttgggaagtgcagggggtcctgggcacattgccagctgggtgctgagcattgagtcactgatctcttgtgatggggccaatgagtcaattgaattcatgggccaaacaggtcccatcctcttcatgaaaaaagtgagctccttactgtgggagagctgcagggagccaaggtgggctgcctgacacacttgccgctctcgtgtgaatccaagaaactgcgttcctcaaaggggccctggttgtcaccttctcccacagccatttccacccatcgttgtctagaatctctttcattagcacattccaacccctctgccacttggtttagaaatgagctccctggctcagtgggcctttcagaatctggaaccagacggaggtggagttaagaagataggacagaacaggcaggccaagttcactgaagcttaagaaaatcatgtttagactctgtttaaaaacatccagg

SEQ ID NO: 368641 - DNA, 1459 bp, Homo sapiens
  misc_feature (166)..(166): n is a, c, g, or t
aaaaaaaaaaaaaaaaaaaaaaaaaaaaaggtttttgaagatggcggccctcaaggctctggtgtccggctgtgggcggcttctccgtgggctactagcgggcccggcagcgaccagctggtctcggcttcccaaaaggggctccttccccgggccccgggggggnggttccaagggaagtggtggagacccaagaagggaagacaactataattgaaggccgtatcacagcgactcccaaggagagtccaaatcctcctaacccctctggccagtgccccatctgccgttggaacctgaagcacaagtataactatgacgatgttctgctgcttagccagttcatccggcctcatggaggcatgctgccccgaaagatcacaggcctatgccaggaagaacaccgcaagatcgaggagtgtgtgaagatggcccaccgagcaggtctattaccaaatcacaggcctcggcttcctgaaggagttgttccgaagagcaaaccccaactcaaccggtacctgacgcgctgggctcctggctccgtcaagcccatctacaaaaaaggcccccgctggaacagggtgcgcatgcccgtggggtcaccccttctgagggacaatgtctgctactcaagaacaccttggaagctgtatcactgacagagagcagtgcttccagagttcctcctgcacctgtgctggggagtaggaggcccactcacaagcccttggccacaactatactcctgtcccaccccaccacgatggcctggtccctccaacatgcatggacaggggacagtgggactaacttcagtacccttggcctgcacagtagcaatgctgggagctagaggcaggcagggcagttgggtcccttgccagctgctatggggcttaggccatgctcagtgctggggacaggagttttgcccaacgcagtgtcataaactgggttcatgggcttacccattgggtgtgcgctcactgcttgggaagtgcagggggtcctgggcacattgccagctgggtgctgagcattgagtcactgatctcttgtgatggggccaatgagtcaattgaattcatgggccaaacaggtcccatcctcttcatgaaaaaagtgagctccttactgtgggagagctgcagggagccaaggtgggctgcctgacacacttgccgctctcgtgtgaatccaagaaactgcgttcctcaaaggggccctggttgtcaccttctcccacagccatttccacccatcgttgtctagaatctctttcattagcacattccaacccctctgccacttggtttagaaatgagctccctggctcagtgggcctttcagaatctggaaccagacggaggtggagttaagaagataggacagaacaggcaggccaagttcactgaagcttaagaaaatcatgtttagactctgtttaaaaacatccagg

SEQ ID NO: 368642 - DNA, 1653 bp, Homo sapiens
aaaaaaaaaaaaaaaaaaaaaaaaaaaaaggtttttgaagatggcggccctcaaggctctggtgtccggctgtgggcggcttctccgtgggctactagcgggcccggcagcgaccagctggtctcggcttccagctcgcgggttcagggaagtggtggagacccaagaagggaagacaactataattgaaggccgtatcacagcgactcccaaggagagtccaaatcctcctaacccctctggccagtgccccatctgccgttggaacctgaagcacaagtataactatgacgatgttctgctgcttagccagttcatccggcctcatggaggcatgctgccccgaaagatcacaggcctatgccaggaagaacaccgcaagatcgaggagtgtgtgaagatggcccaccgagcaggtagaaggccctggggaccaagaggggcagagggctgcaggcactctctccccacccagctgccccatgtttcagcccctcctggaagaaaagtggatatccggagtgttaattatactcaccacccaatgccaaccttcccgctcccttgggctttccctctggccccctcagagctgcagagggagctgcaaagactatcccctcttccccgccactcaggtctattaccaaatcacaggcctcggcttcctgaaggagttgttccgaagagcaaaccccaactcaaccggtacctgacgcgctgggctcctggctccgtcaagcccatctacaaaaaaggcccccgctggaacagggtgcgcatgcccgtggggtcaccccttctgagggacaatgtctgctactcaagaacaccttggaagctgtatcactgacagagagcagtgcttccagagttcctcctgcacctgtgctggggagtaggaggcccactcacaagcccttggccacaactatactcctgtcccaccccaccacgatggcctggtccctccaacatgcatggacaggggacagtgggactaacttcagtacccttggcctgcacagtagcaatgctgggagctagaggcaggcagggcagttgggtcccttgccagctgctatggggcttaggccatgctcagtgctggggacaggagttttgcccaacgcagtgtcataaactgggttcatgggcttacccattgggtgtgcgctcactgcttgggaagtgcagggggtcctgggcacattgccagctgggtgctgagcattgagtcactgatctcttgtgatggggccaatgagtcaattgaattcatgggccaaacaggtcccatcctcttcatgaaaaaagtgagctccttactgtgggagagctgcagggagccaaggtgggctgcctgacacacttgccgctctcgtgtgaatccaagaaactgcgttcctcaaaggggccctggttgtcaccttctcccacagccatttccacccatcgttgtctagaatctctttcattagcacattccaacccctctgccacttggtttagaaatgagctccctggctcagtgggcctttcagaatctggaaccagacggaggtggagttaagaagataggacagaacaggcaggccaagttcactgaagcttaagaaaatcatgtttagactctgtttaaaaacatccagg

SEQ ID NO: 368643 - DNA, 1161 bp, Homo sapiens
aaaaaaaaaaaaaaaaaaaaaaaaaaaaaggtttttgaagatggcggccctcaaggctctggtgtccggctgtgggcggcttctccgtgggctactagcgggcccggcagcgaccagctggtctcggcttccagctcgcgggttcagggaagtggtggagacccaagaagggaagacaactataattgaaggccgtatcacagcgactcccaaggagagtccaaatcctcctaacccctctggccagtgccccatctgccgttggaacctgaagcacaagtataactatgacgatgttctgctgcttagccagttcatccggcctcatggaggcatgctgccccgaaagatcacaggcctatgccaggaagaacaccgcaagatcgaggagtgtgtgaagatggcccaccgagcaggtagaaggccctggggaccaagaggggcagagggctgcaggcactctctccccacccagctgccccatgtttcagcccctcctggaagaaaagtggatatccggagtgttaattatactcaccacccaatgccaaccttcccgctcccttgggctttccctctggccccctcagagctgcagagggagctgcaaagactatcccctcttccccgccactcaggtctattaccaaatcacaggcctcggcttcctgaaggagttgttccgaagagcaaaccccaactcaaccggtacctgacgcgctgggctcctggctccgtcaagcccatctacaaaaaaggcccccgctggaacagggtgcgcatgcccgtggggtcaccccttctgagggacaatgtctgctactcaagaacaccttggaagctgtatcactgacagagagcagtgcttccagagttcctcctgcacctgtgctggggagtaggaggcccactcacaagcccttggccacaactatactcctgtcccaccccaccacgatggcctggtccctccaacatgcatggacaggggacagtgggactaacttcagtacccttggcctgcacagtagcaatgctgggagctagaggcaggcagggcagttgggtcccttgccagctgctatggggcttaggccatgctcagtgctggggacaggagttttgcccaacgcagtgtcataaactgggttcatgggctta

SEQ ID NO: 368644 - DNA, 869 bp, Homo sapiens
aaaaaaaaaaaaaaaaaaaaaaaaaaaaaggtttttgaagatggcggccctcaaggctctggtgtccggctgtgggcggcttctccgtgggctactagcgggcccggcagcgaccagctggtctcggcttccagctcgcgggttcagggaagtggtggagacccaagaagggaagacaactataattgaaggccgtatcacagcgactcccaaggagagtccaaatcctcctaacccctctggccagtgccccatctgccgttggaacctgaagcacaagtataactatgacgatgttctgctgcttagccagttcatccggcctcatggaggcatgctgccccgaaagatcacaggcctatgccaggaagaacaccgcaagatcgaggagtgtgtgaagatggcccaccgagcaggtacctgacgcgctgggctcctggctccgtcaagcccatctacaaaaaaggcccccgctggaacagggtgcgcatgcccgtggggtcaccccttctgagggacaatgtctgctactcaagaacaccttggaagctgtatcactgacagagagcagtgcttccagagttcctcctgcacctgtgctggggagtaggaggcccactcacaagcccttggccacaactatactcctgtcccaccccaccacgatggcctggtccctccaacatgcatggacaggggacagtgggactaacttcagtacccttggcctgcacagtagcaatgctgggagctagaggcaggcagggcagttgggtcccttgccagctgctatggggcttaggccatgctcagtgctggggacaggagttttgcccaacgcagtgtcataaactgggttcatgggctta

SEQ ID NO: 368645 - DNA, 913 bp, Homo sapiens
  misc_feature (527)..(527): n is a, c, g, or t
aaaaaaaaaaaaaaaaaaaaaaaaaaaaaggtttttgaagatggcggccctcaaggctctggtgtccggctgtgggcggcttctccgtgggctactagcgggcccggcagcgaccagctggtctcggcttccagctcgcgggttcagggaagtggtgcgagaccccaaagaaaggggaagaacaaacttataattgaagggccggtattcaccaggcggaacttccccaagggagaggttccaaaattccttccttaaagcccctctgggccagtggccccaattccttggccggtttgggaaccctttggaagcacaaaggttttaacttattggacggaaggtccttggacagtggagttaagcaccgagatctccatgtccggggcccttcacgggaaagggccatgtgcttggccccacgggcaagagaatctcacacggggccctatagggccccggggtcaggggaaacacaccgcaaacaaaggaactccgcagggcacggcgtgggctgtctggaaggnaataggggccccacaccgggaaggacaggagggctcataatacacccgagaatactacaacgagggccccatgcggggcttccccgtgcacaagcgagcaagttagtgatcccagcaggaagaagacggccaaaaaaaccccctcgaaaagtcttcaagcccgggggatcaccccggaggacgcgcagtctgggagcgcctctggggaggcatcgaggcacaaagacgcccagcagtctcataccaccaatcagcaggtgggcccccacgcgtggggcgaacctatggggatctggcagcatgttgccggcgggggggggtctaacacccccatttctcgtggagggggccccacgcgggctggcgactagcgccggagaaaaagc

SEQ ID NO: 368646 - DNA, 1431 bp, Homo sapiens
aaaaaaaaaaaaaaaaaaaaaaaaaaaaaggtttttgaagatggcggccctcaaggctctggtgtccggctgtgggcggcttctccgtgggctactagcgggcccggcagcgaccagctggtctcggcttccagctcgcgggttcagggaagtggtggagacccaagaagggaagacaactataattgaaggccgtatcacagcgactcccaaggagagtccaaatcctcctaacccctctggccagtgccccatctgccgttggaacctgaagcacaagtataactatgacgatgttctgctgcttagccagttcatccggcctcatggaggcatgctgccccgaaagatcacaggcctatgccaggaagaacaccgcaagatcgaggagtgtgtgaagatggcccaccgagcaggtctattaccaaatcacaggcctcggcttcctgaaggagttgttccgaagagcaaaccccaactcaaccggtacctgacgcgctgggctcctggctccgtcaagcccatctacaaaaaaggcccccgctggaacagggtgcgcatgcccgtggggtcaccccttctgagggacaatgtctgctactcaagaacaccttggaagctgtatcactgacagagagcagtgcttccagagttcctcctgcacctgtgctggggagtaggaggcccactcacaagcccttggccacaactatactcctgtcccaccccaccacgatggcctggtccctccaacatgcatggacaggggacagtgggactaacttcagtacccttggcctgcacagtagcaatgctgggagctagaggcaggcagggcagttgggtcccttgccagctgctatggggcttaggccatgctcagtgctggggacaggagttttgcccaacgcagtgtcataaactgggttcatgggcttacccattgggtgtgcgctcactgcttgggaagtgcagggggtcctgggcacattgccagctgggtgctgagcattgagtcactgatctcttgtgatggggccaatgagtcaattgaattcatgggccaaacaggtcccatcctcttcatgaaaaaagtgagctccttactgtgggagagctgcagggagccaaggtgggctgcctgacacacttgccgctctcgtgtgaatccaagaaactgcgttcctcaaaggggccctggttgtcaccttctcccacagccatttccacccatcgttgtctagaatctctttcattagcacattccaacccctctgccacttggtttagaaatgagctccctggctcagtgggcctttcagaatctggaaccagacggaggtggagttaagaagataggacagaacaggcaggccaagttcactgaagcttaagaaaatcatgtttagactctgtttaaaaacatccagg

SEQ ID NO: 368647 - DNA, 939 bp, Homo sapiens
aaaaaaaaaaaaaaaaaaaaaaaaaaaaaggtttttgaagatggcggccctcaaggctctggtgtccggctgtgggcggcttctccgtgggctactagcgggcccggcagcgaccagctggtctcggcttccagctcgcgggttcagggaagtggtggagacccaagaagggaagacaactataattgaaggccgtatcacagcgactcccaaggagagtccaaatcctcctaacccctctggccagtgccccatctgccgttggaacctgaagcacaagtataactatgacgatgttctgctgcttagccagttcatccggcctcatggaggcatgctgccccgaaagatcacaggcctatgccaggaagaacaccgcaagatcgaggagtgtgtgaagatggcccaccgagcaggtctattaccaaatcacaggcctcggcttcctgaaggagttgttccgaagagcaaaccccaactcaaccggtacctgacgcgctgggctcctggctccgtcaagcccatctacaaaaaaggcccccgctggaacagggtgcgcatgcccgtggggtcaccccttctgagggacaatgtctgctactcaagaacaccttggaagctgtatcactgacagagagcagtgcttccagagttcctcctgcacctgtgctggggagtaggaggcccactcacaagcccttggccacaactatactcctgtcccaccccaccacgatggcctggtccctccaacatgcatggacaggggacagtgggactaacttcagtacccttggcctgcacagtagcaatgctgggagctagaggcaggcagggcagttgggtcccttgccagctgctatggggcttaggccatgctcagtgctggggacaggagttttgcccaacgcagtgtcataaactgggttcatgggctta

SEQ ID NO: 368648 - DNA, 1361 bp, Homo sapiens
aaaaaaaaaaaaaaaaaaaaaaaaaaaaaggtttttgaagatggcggccctcaaggctctggtgtccggctgtgggcggcttctccgtgggctactagcgggcccggcagcgaccagctggtctcggcttccagctcgcgggttcagggaagtggtggagacccaagaagggaagacaactataattgaaggccgtatcacagcgactcccaaggagagtccaaatcctcctaacccctctggccagtgccccatctgccgttggaacctgaagcacaagtataactatgacgatgttctgctgcttagccagttcatccggcctcatggaggcatgctgccccgaaagatcacaggcctatgccaggaagaacaccgcaagatcgaggagtgtgtgaagatggcccaccgagcaggtacctgacgcgctgggctcctggctccgtcaagcccatctacaaaaaaggcccccgctggaacagggtgcgcatgcccgtggggtcaccccttctgagggacaatgtctgctactcaagaacaccttggaagctgtatcactgacagagagcagtgcttccagagttcctcctgcacctgtgctggggagtaggaggcccactcacaagcccttggccacaactatactcctgtcccaccccaccacgatggcctggtccctccaacatgcatggacaggggacagtgggactaacttcagtacccttggcctgcacagtagcaatgctgggagctagaggcaggcagggcagttgggtcccttgccagctgctatggggcttaggccatgctcagtgctggggacaggagttttgcccaacgcagtgtcataaactgggttcatgggcttacccattgggtgtgcgctcactgcttgggaagtgcagggggtcctgggcacattgccagctgggtgctgagcattgagtcactgatctcttgtgatggggccaatgagtcaattgaattcatgggccaaacaggtcccatcctcttcatgaaaaaagtgagctccttactgtgggagagctgcagggagccaaggtgggctgcctgacacacttgccgctctcgtgtgaatccaagaaactgcgttcctcaaaggggccctggttgtcaccttctcccacagccatttccacccatcgttgtctagaatctctttcattagcacattccaacccctctgccacttggtttagaaatgagctccctggctcagtgggcctttcagaatctggaaccagacggaggtggagttaagaagataggacagaacaggcaggccaagttcactgaagcttaagaaaatcatgtttagactctgtttaaaaacatccagg

SEQ ID NO: 368649 - DNA, 1412 bp, Homo sapiens
aaaaaaaaaaaaaaaaaaaaaaaaaaaaaggtttttgaagatggcggccctcaaggctctggtgtccggctgtgggcggcttctccgtgggctactagcgggcccggcagcgaccagctggtctcggcttccagctcgcgggttcagggaagtggtggagacccaagaagggaagacaactataattgaaggccgtatcacagcgactcccaaggagagtccaaatcctcctaacccctctggccagtgccccatctgccgttggaacctgaagcacaagtataactatgacgatgttctgctgcttagccagttcatccggcctcatggaggcatgctgccccgaaagatcacaggcctatgccaggaagaacaccgcaagatcgaggagtgtgtgaagatggcccaccgagcaggcctcggcttcctgaaggagttgttccgaagagcaaaccccaactcaaccggtacctgacgcgctgggctcctggctccgtcaagcccatctacaaaaaaggcccccgctggaacagggtgcgcatgcccgtggggtcaccccttctgagggacaatgtctgctactcaagaacaccttggaagctgtatcactgacagagagcagtgcttccagagttcctcctgcacctgtgctggggagtaggaggcccactcacaagcccttggccacaactatactcctgtcccaccccaccacgatggcctggtccctccaacatgcatggacaggggacagtgggactaacttcagtacccttggcctgcacagtagcaatgctgggagctagaggcaggcagggcagttgggtcccttgccagctgctatggggcttaggccatgctcagtgctggggacaggagttttgcccaacgcagtgtcataaactgggttcatgggcttacccattgggtgtgcgctcactgcttgggaagtgcagggggtcctgggcacattgccagctgggtgctgagcattgagtcactgatctcttgtgatggggccaatgagtcaattgaattcatgggccaaacaggtcccatcctcttcatgaaaaaagtgagctccttactgtgggagagctgcagggagccaaggtgggctgcctgacacacttgccgctctcgtgtgaatccaagaaactgcgttcctcaaaggggccctggttgtcaccttctcccacagccatttccacccatcgttgtctagaatctctttcattagcacattccaacccctctgccacttggtttagaaatgagctccctggctcagtgggcctttcagaatctggaaccagacggaggtggagttaagaagataggacagaacaggcaggccaagttcactgaagcttaagaaaatcatgtttagactctgtttaaaaacatccagg

SEQ ID NO: 368650 - DNA, 846 bp, Homo sapiens
aaaaaaaaaaaaaaaaaaaaaaaaaaaaaggtttttgaagatggcggccctcaaggctctggtgtccggctgtgggcggcttctccgtgggctactagcgggcccggcagcgaccagctggtctcggcttccagctcgcgggttcagggaagtggtggagacccaagaagggaagacaactataattgaaggccgtatcacagcgactcccaaggagagtccaaatcctcctaacccctctggccagtgccccatctgccgttggaacctgaagcacaagtataactatgacgatgttctgctgcttagccagttcatccggcctcatggaggcatgctgccccgaaagatcacaggcctatgccaggaagaacaccgcaagatcgaggagtgtgtgaagatggcccaccgagcaggtagaaggccctggggaccaagaggggcagagggctgcaggcactctctccccacccagctgccccatgtttcagcccctcctggaagaaaagtggatatccggagtgtatcatatcacacaatgcaactttccgtcctggtttccttggccctagagtgcaggagttgaaagatatccctatttccgcatcagtctataccaatcaaggcggtcctgaggagtgcgagagaaccaatcaaggacagcggcgggctggcgaggcctaaaaggcaggaagggcgcgggccttgagtgtgcaacctggttggagaggcgtcccctgtgccctcctccctaacgggggtgtcgtgcttgcgtcacgcagaaagagcagaaagacaacaaaaaacagacacccacaacgaacaaagaaagaaaaaaacagaaag

SEQ ID NO: 368651 - DNA, 496 bp, Homo sapiens
agaggaatataaaagcagtgggatatctggatttcttatactcagtcaaccacaacatggccttagtactgaactagcccagggtttcaatggaactcgtagatctcattcccaaggctggtcctggttgaagggagaaggtcaaaaaaggacgtgtcttctgaaaggcattacccatggaaagccaagggggagggttgcccactaggaggagcttcttttgtagaagccagaatggaggaaaggggctttctgacttggagcatctgaggaaatagattatttgaggatctagtactcccagaataatctgtaaccacaagaaacacatttcttgaactccagcgccccagaacaggatatccatatccaatcccatcgtatccatcctggatgttatgaatttccagagagggccacttctacccccctaggagtcatacatctggctacttatttgttaaaaataaaattctgtaccatttataaaatgggc

SEQ ID NO: 368652 - DNA, 543 bp, Homo sapiens
tcggccgccacggacggagactgaggctcagaggggacaagacctgcttgaggtcacacaggcagttgagagcagagctgagtcttgaacttgggtctggctgatacccaagactgtccccactgcaatgtgacactcccagcctccagcggaagccttgggagcaggtccccaaaaagccaaagcggaagaaaaggcggcgacgcaacgtgaactgcctgaagaacgtggtgatctggtacgaggaccacaagcaccgctgcccgtacgagccgcacctggcggagctagaccccacttttggcctgtacaccacggccgtgtggcagtgcgaagctggccaccgctacttccaggacctgcattcgcccctgaagcccctcagcgactcagaccctgacagtgacaaaggtaggtctgcagggcgagggcacatagggggccgcccatttctgggggcttcttacgagccctaggctagcatcacaaacagaatagcagccacagtggctctggctctggctctggcactggggcagagca

SEQ ID NO: 368653 - DNA, 3240 bp, Homo sapiens
gctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgcatgcgcagtttccattcttggtctccttttggcgccctggggcagcgagagaccgtgagaaatttctcggcggcgccgaagatgcgcgccacttccggtctggctcctaacaacgggggaggctggtaaccagggtgggggggatggcggagcgggcgctagagcccgaggcggaggcggaggctgaggcgggcgcgggcggggaggcagcagccgaggagggcgcagcgggccgaaaggcgcggggccggccgcgactcacggagtcggaccgggcccggcgacggctcgagtcccggaagaagtacgacgtgcggcgcgtgtacctgggcgaggcgcacgggccctgggtggacctgcggcgccgcagcggctggagcgacgccaagctcgccgcctacctcatctctctggagcgcggccagcggagcggccgccacgggtgagggggcctggccccgagggagggagggaggagacgcccccagaccccgccgggctttaccccgccccctccgcttctagggccagcccccggcacctgcggaccccgcccaggagccgggccggcggcctgggtctcgtactgcctggccgggacgcgcctggctcgtggccccgcctcccatcgttccgactgcccaatcctagggtgcacccagcccctcgacccgccttctgagcgcttggccccgcccgctagaactctggcggcccaatcctgggactggccccacctccaggccttgtaactaaccaggccctgggggggcagccccgccccctcaccggtctcatcctcccccgcttagttccccacctggcctgggactctggacaccctggggcactcagccctgcccttcttgaagttctggtgccccatctgggactccgtatggccccattcccacaaccctagatccaacacatccgggggacccttcacaacctggactgcactcccctaaacctatttctgtgaagcaactcagcccagggagactcggatgaagaggaaacccctagttagcttggcaggtggagggcagagaggcctgtctttgtaaattctcagtcttgagaaggagcagtgtggatggagtttttcccttcctgccttatatgttgatgtgatgattgagttaaaataggcaaagagcttagaagagtgcctggcaggtagtgggttccctaagtattaacttttacgaggatgacgtttattccgtatcacaagcagtgccgcaaggaaatccttgttctgccctggttttcaggaagccttgggagcaggtccccaaaaagccaaagcggaagaaaaggcggcgacgcaacgtgaactgcctgaagaacgtggtgatctggtacgaggaccacaagcaccgctgcccgtacgagccgcacctggcggagctagaccccacttttggcctgtacaccacggccgtgtggcagtgcgaagctggccaccgctacttccaggacctgcattcgcccctgaagcccctcagcgactcagaccctgacagtgacaaagtgggcaatgggctggtggctggcagctctgactcatccagctctggctctgcctctgactctgaggagtctcctgagggccagccggtcaaggctgcggcagcggcagcggcagcgacgcccaccagcccggtgggcagcagcgggctcatcactcaggagggcgtgcacattccctttgacgtccaccacgtggaaagcctggccgagcagggtaccccgctgtgctccaacccagcaggcaatgggcctgaagccctggagacagtggtgtgcgtgccggtgcctgtgcaagtgggtgcgggccccagcgccctctttgagaacgtgccccaggaggccctgggtgaggtggtggccagctgccccatgccaggcatggtgcccggctcacaggtgatcatcattgcgggccctggttacgacgctctcacggccgagggcattcacctcaacatggcagcaggcagcggtgtccccggcagtggactgggcgaggaggtgccctgtgccatgatggagggtgtggcagcctacacccagacagagcccgagggtagccagcctagcaccatggacgccaccgcagtagcaggcatcgagaccaagaaagagaaggaggacctgtgcttgctaaagaaggaggagaaggaggagccagtagccccggagctggcaacaacggtgcctgagagcgcagagcctgaggcagaggcggacggggaggagctggacggcagcgacatgtcagccatcatctatgaaatccccaaggagcctgagaagaggcggcggagcaagcggtcgcgggtgatggatgctgacggcctgctcgagatgttccactgcccatacgagggctgcagccaagtctacgtggccctcagcagcttccagaaccacgtcaatcttgtgcatcggaaaggaaagaccaaagtgtgccctcatcctggctgtggcaagaagttctatttatccaaccacctgcggcggcacatgatcatccattcaggtgtccgtgaattcacctgcgagacctgcggcaagtccttcaagaggaagaaccacctggaggtacatcggcgcacccacaccggcgagacccccctgcagtgcgagatctgtggctaccagtgccggcagcgcgcgtcgctcaactggcacatgaagaagcacactgcggaggtgcagtacaacttcacgtgcgatcgctgcgggaagcgcttcgagaagctggacagcgtcaagttccacacgctcaaaagccacccggatcacaagcccacctgacccacctgaccactgaccgcccctatttattcgtccgctcggacaccacgcccgggcttgccggggcctggacagctgcgagggccgcccggaccgcgggccggaaggaggcgcccccgccccgccccagagctgggccccctgggcaggttccccaccccgccccaccgcatccttctcggagctggtgcctggggctgcattgctggaactgtgtcaagagagcagagtgagattaaagagcgagaaaggaaaaaaaa

SEQ ID NO: 368654 - DNA, 2364 bp, Homo sapiens
gctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgcatgcgcagtttccattcttggtctccttttggcgccctggggcagcgagagaccgtgagaaatttctcggcggcgccgaagatgcgcgccacttccggtctggctcctaacaacgggggaggctggtaaccagggtgggggggatggcggagcgggcgctagagcccgaggcggaggcggaggctgaggcgggcgcgggcggggaggcagcagccgaggagggcgcagcgggccgaaaggcgcggggccggccgcgactcacggagtcggaccgggcccggcgacggctcgagtcccggaagaagtacgacgtgcggcgcgtgtacctgggcgaggcgcacgggccctgggtggacctgcggcgccgcagcggctggagcgacgccaagctcgccgcctacctcatctctctggagcgcggccagcggagcggccgccacgggaagccttgggagcaggtccccaaaaagccaaagcggaagaaaaggcggcgacgcaacgtgaactgcctgaagaacgtggtgatctggtacgaggaccacaagcaccgctgcccgtacgagccgcacctggcggagctagaccccacttttggcctgtacaccacggccgtgtggcagtgcgaagctggccaccgctacttccaggacctgcattcgcccctgaagcccctcagcgactcagaccctgacagtgacaaagtgggcaatgggctggtggctggcagctctgactcatccagctctggctctgcctctgactctgaggagtctcctgagggccagccggtcaaggctgcggcagcggcagcggcagcgacgcccaccagcccggtgggcagcagcgggctcatcactcaggagggcgtgcacattccctttgacgtccaccacgtggaaagcctggccgagcagggtaccccgctgtgctccaacccagcaggcaatgggcctgaagccctggagacagtggtgtgcgtgccggtgcctgtgcaagtgggtgcgggccccagcgccctctttgagaacgtgccccaggaggccctgggtgaggtggtggccagctgccccatgccaggcatggtgcccggctcacaggtgatcatcattgcgggccctggttacgacgctctcacggccgagggcattcacctcaacatggcagcaggcagcggtgtccccggcagtggactgggcgaggaggtgccctgtgccatgatggagggtgtggcagcctacacccagacagagcccgagggtagccagcctagcaccatggacgccaccgcagtagcaggcatcgagaccaagaaagagaaggaggacctgtgcttgctaaagaaggaggagaaggaggagccagtagccccggagctggcaacaacggtgcctgagagcgcagagcctgaggcagaggcggacggggaggagctggacggcagcgacatgtcagccatcatctatgaaatccccaaggagcctgagaagaggcggcggagcaagcggtcgcgggtgatggatgctgacggcctgctcgagatgttccactgcccatacgagggctgcagccaagtctacgtggccctcagcagcttccagaaccacgtcaatcttgtgcatcggaaaggaaagaccaaagtgtgccctcatcctggctgtggcaagaagttctatttatccaaccacctgcggcggcacatgatcatccattcaggtgtccgtgaattcacctgcgagacctgcggcaagtccttcaagaggaagaaccacctggaggtgcgagatctgtggctaccagtgccggcagcgcgcgtcgctcaactggcacatgaagaagcacactgcggaggtgcagtacaacttcacgtgcgatcgctgcgggaagcgcttcgagaagctggacagcgtcaagttccacacgctcaaaagccacccggatcacaagcccacctgacccacctgaccactgaccgcccctatttattcgtccgctcggacaccacgcccgggcttgccggggcctggacagctgcgagggccgcccggaccgcgggccggaaggaggcgcccccgccccgccccagagctgggccccctgggcaggttccccaccccgccccaccgcatccttctcggagctggtgcctggggctgcattgctggaactgtgtcaagagagcagagtgagattaaagagcgagaaaggaaaaaaaa

SEQ ID NO: 368655 - DNA, 2402 bp, Homo sapiens
gctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgcatgcgcagtttccattcttggtctccttttggcgccctggggcagcgagagaccgtgagaaatttctcggcggcgccgaagatgcgcgccacttccggtctggctcctaacaacgggggaggctggtaaccagggtgggggggatggcggagcgggcgctagagcccgaggcggaggcggaggctgaggcgggcgcgggcggggaggcagcagccgaggagggcgcagcgggccgaaaggcgcggggccggccgcgactcacggagtcggaccgggcccggcgacggctcgagtcccggaagaagtacgacgtgcggcgcgtgtacctgggcgaggcgcacgggccctgggtggacctgcggcgccgcagcggctggagcgacgccaagctcgccgcctacctcatctctctggagcgcggccagcggagcggccgccacgggaagccttgggagcaggtccccaaaaagccaaagcggaagaaaaggcggcgacgcaacgtgaactgcctgaagaacgtggtgatctggtacgaggaccacaagcaccgctgcccgtacgagccgcacctggcggagctagaccccacttttggcctgtacaccacggccgtgtggcagtgcgaagctggccaccgctacttccaggacctgcattcgcccctgaagcccctcagcgactcagaccctgacagtgacaaagtgggcaatgggctggtggctggcagctctgactcatccagctctggctctgcctctgactctgaggagtctcctgagggccagccggtcaaggctgcggcagcggcagcggcagcgacgcccaccagcccggtgggcagcagcgggctcatcactcaggagggcgtgcacattccctttgacgtccaccacgtggaaagcctggccgagcagggtaccccgctgtgctccaacccagcaggcaatgggcctgaagccctggagacagtggtgtgcgtgccggtgcctgtgcaagtgggtgcgggccccagcgccctctttgagaacgtgccccaggaggccctgggtgaggtggtggccagctgccccatgccaggcatggtgcccggctcacaggtgatcatcattgcgggccctggttacgacgctctcacggccgagggcattcacctcaacatggcagcaggcagcggtgtccccggcagtggactgggcgaggaggtgccctgtgccatgatggagggtgtggcagcctacacccagacagagcccgagggtagccagcctagcaccatggacgccaccgcagtagcaggcatcgagaccaagaaagagaaggaggacctgtgcttgctaaagaaggaggagaaggaggagccagtagccccggagctggcaacaacggtgcctgagagcgcagagcctgaggcagaggcggacggggaggagctggacggcagcgacatgtcagccatcatctatgaaatccccaaggagcctgagaagaggcggcggagcaagcggtcgcgggtgatggatgctgacggcctgctcgagatgttccactgcccatacgagggctgcagccaagtctacgtggccctcagcagcttccagaaccacgtcaatcttgtgcatcggaaaggaaagaccaaagtgtgccctcatcctggctgtggcaagaagttctatttatccaaccacctgcggcggcacatgatcatccattcaggtgtccgtgaattcacctgcgagacctgcggcaagtccttcaagaggaagaaccacctggaggtacatcggcgcacccacaccggcgagacccccctgcagtgcgagatctgtggctaccagtgccggcagcgcgcgtcgctcaactggcacatgaagaagcacactgcggaggtgcagtacaacttcacgtgcgatcgctgcgggaagcgcttcgagaagctggacagcgtcaagttccacacgctcaaaagccacccggatcacaagcccacctgacccacctgaccactgaccgcccctatttattcgtccgctcggacaccacgcccgggcttgccggggcctggacagctgcgagggccgcccggaccgcgggccggaaggaggcgcccccgccccgccccagagctgggccccctgggcaggttccccaccccgccccaccgcatccttctcggagctggtgcctggggctgcattgctggaactgtgtcaagagagcagagtgagattaaagagcgagaaaggaaaaaaaa

SEQ ID NO: 368656 - DNA, 2584 bp, Homo sapiens
gctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgcatgcgcagtttccattcttggtctccttttggcgccctggggcagcgagagaccgtgagaaatttctcggcggcgccgaagatgcgcgccacttccggtctggctcctaacaacgggggaggctggtaaccagggtgggggggatggcggagcgggcgctagagcccgaggcggaggcggaggctgaggcgggcgcgggcggggaggcagcagccgaggagggcgcagcgggccgaaaggcgcggggccggccgcgactcacggagtcggaccgggcccggcgacggctcgagtcccggaagaagtacgacgtgcggcgcgtgtacctgggcgaggcgcacgggccctgggtggacctgcggcgccgcagcggctggagcgacgccaagctcgccgcctacctcatctctctggagcgcggccagcggagcggccgccacgggaagccttgggagcaggtccccaaaaagccaaagcggaagaaaaggcggcgacgcaacgtgaactgcctgaagaacgtggtgatctggtacgaggaccacaagcaccgctgcccgtacgagccgcacctggcggagctagaccccacttttggcctgtacaccacggccgtgtggcagtgcgaagctggccaccgctacttccaggacctgcattcgcccctgaagcccctcagcgactcagaccctgacagtgacaaagtgggcaatgggctggtggctggcagctctgactcatccagctctggctctgcctctgactctgaggagtctcctgagggccagccggtcaaggctgcggcagcggcagcggcagcgacgcccaccagcccggtgggcagcagcgggctcatcactcaggagggcgtgcacattccctttgacgtccaccacgtggaaagcctggccgagcagggtaccccgctgtgctccaacccagcaggcaatgggcctgaagccctggagacagtggtgtgcgtgccggtgcctgtgcaagtgggtgcgggccccagcgccctctttgagaacgtgccccaggaggccctgggtgaggtggtggccagctgccccatgccaggcatggtgcccggctcacaggtgatcatcattgcgggccctggttacgacgctctcacggccgagggcattcacctcaacatggcagcaggcagcggtgtccccggcagtggactgggcgaggaggtgccctgtgccatgatggagggtgtggcagcctacacccagacagagcccgagggtagccagcctagcaccatggacgccaccgcagtagcaggcatcgagaccaagaaagagaaggaggacctgtgcttgctaaagaaggaggagaaggaggagccagtagccccggagctggcaacaacggtgcctgagagcgcagagcctgaggcagaggcggacggggaggagctggacggcagcgacatgtcagccatcatctatgaaatccccaaggagcctgagaagaggcggcggagcaagcggtcgcgggtgatggatgctgacggcctgctcgagatgttccactgcccatacgagggctgcagccaagtctacgtggccctcagcagcttccagaaccacgtcaatcttgtgcatcggaaaggaaagaccaaagtgtgccctcatcctggctgtggcaagaagttctatttatccaaccacctgcggcggcacatgatcatccattcaggtgtccgtgaattcacctgcgagacctgcggcaagtccttcaagaggaagaaccacctggaggtacatcggcgcacccacaccggcgagacccccctgcagtgagtgacaggccgccccgtgccgctagaggattgggtgggaggggatcccagcaggtcccaggggcggcttcgccccaacgcagtgtctgggcccggttccacctgcgctcggccttgtagggccccgccccgccccgcccactctgaccccgccccgtcccgccacgggctcccggcaggtgcgagatctgtggctaccagtgccggcagcgcgcgtcgctcaactggcacatgaagaagcacactgcggaggtgcagtacaacttcacgtgcgatcgctgcgggaagcgcttcgagaagctggacagcgtcaagttccacacgctcaaaagccacccggatcacaagcccacctgacccacctgaccactgaccgcccctatttattcgtccgctcggacaccacgcccgggcttgccggggcctggacagctgcgagggccgcccggaccgcgggccggaaggaggcgcccccgccccgccccagagctgggccccctgggcaggttccccaccccgccccaccgcatccttctcggagctggtgcctggggctgcattgctggaactgtgtcaagagagcagagtgagattaaagagcgagaaaggaaaaaaaa

SEQ ID NO: 368657 - DNA, 1743 bp, Homo sapiens
cgtctgttcgcagagctgtgggcggagttgaggccttggaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcaggtggcatcagaaatgggtcttatgacattggcatggcctgtggggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcagggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggggtgttgagccacccatcagaccctctttagctgtgcaagataaaagcagcctgggtcacccaggccacaaggccatggttaattcttaaggcaaggcaaatccatggatgagaagtgcaatgggcatagtaaaagtgcatgaattta

SEQ ID NO: 368658 - DNA, 414 bp, Homo sapiens
gaaggtgaaccccctggggtgacagtggccttagggacccactgggctgcactggggcacgacaggtcatcacgctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcagggctgacagtgagtgacgtggacatcttcgagatcaatgaggcctttgcaagccagctgagattgtgcctgtgaccaccacggtccatgatgacaagggcaccaagaggagcatcactgtgacccaggatgagggtatccgccccagcaccaccatggagggcctggcaaactgaagtcctgctgctcta

SEQ ID NO: 368659 - DNA, 1681 bp, Homo sapiens
  misc_feature (20)..(20): n is a, c, g, or t
cccccccccgagaggacttnggctaggtcgaggcttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcaggtggcatcagaaatgggtcttatgacattggcatggcctgtggggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcagggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggggtgttgagccacccatcagaccctctttagctgtgcaagataaaagcagcctgggtcacccaggccacaaggccatggttaattcttaaggcaaggcaaatccatggatgagaagtgcaatgggcatagtaaaagtgcatgaattta

SEQ ID NO: 368660 - DNA, 1911 bp, Homo sapiens
cgtctgttcgcagagctgtgggcggagttgaggccttggaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcaggtggcatcagaaatgggtcttatgacattggcatggcctgtggggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggtgagactggtccggggtaggggtatgagaaagcaggccatggccatgctgggtgctgtactctgggaacctggaatagaccaggcccctctgcaaagtagaagtgggagggctgggatctcctcatccccaccccgatgccttcttaccccaacagtttgcccctaggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcagggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggggtgttgagccacccatcagaccctctttagctgtgcaagataaaagcagcctgggtcacccaggccacaaggccatggttaattcttaaggcaaggcaaatccatggatgagaagtgcaatgggcatagtaaaagtgcatgaattta

SEQ ID NO: 368661 - DNA, 1695 bp, Homo sapiens
cgtctgttcgcagagctgtgggcggagttgaggccttggaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcaggtggcatcagaaatgggtcttatgacattggcatggcctgtggggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcagggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggttggtgattttttaaacaaacattgcctttctcaagaacacagccctggtatttacgttgtccagggcgattattattttggttgaatattaaattattttca

SEQ ID NO: 368662 - DNA, 1563 bp, Homo sapiens
cgtctgttcgcagagctgtgggcggagttgaggccttggaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcaggtggcatcagaaatgggtcttatgacattggcatggcctgtggggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctgggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggggtgttgagccacccatcagaccctctttagctgtgcaagataaaagcagcctgggtcacccaggccacaaggccatggttaattcttaaggcaaggcaaatccatggatgagaagtgcaatgggcatagtaaaagtgcatgaattta

SEQ ID NO: 368663 - DNA, 1744 bp, Homo sapiens
  misc_feature (1294)..(1294): n is a, c, g, or t
  misc_feature (1297)..(1297): n is a, c, g, or t
  misc_feature (1300)..(1301): n is a, c, g, or t
  misc_feature (1304)..(1304): n is a, c, g, or t
  misc_feature (1329)..(1329): n is a, c, g, or t
  misc_feature (1334)..(1335): n is a, c, g, or t
  misc_feature (1337)..(1337): n is a, c, g, or t
  misc_feature (1346)..(1346): n is a, c, g, or t
  misc_feature (1348)..(1348): n is a, c, g, or t
  misc_feature (1364)..(1364): n is a, c, g, or t
  misc_feature (1370)..(1371): n is a, c, g, or t
  misc_feature (1376)..(1376): n is a, c, g, or t
  misc_feature (1382)..(1383): n is a, c, g, or t
  misc_feature (1395)..(1396): n is a, c, g, or t
  misc_feature (1398)..(1398): n is a, c, g, or t
  misc_feature (1403)..(1405): n is a, c, g, or t
  misc_feature (1412)..(1412): n is a, c, g, or t
  misc_feature (1415)..(1415): n is a, c, g, or t
  misc_feature (1417)..(1418): n is a, c, g, or t
  misc_feature (1420)..(1420): n is a, c, g, or t
cgtctgttcgcagagctgtgggcggagttgaggccttggaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcaggtggcatcagaaatgggtcttatgacattggcatggcctgtggggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcagggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacanttnttnnttntttttttttttttttatctcctttntaagnntncatacgtantnttttcctttttcttcnttactnnaattntatccnnttccttcttttnntnccctnnntatcttnttntnntntcttttttgtattcctattcatacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggggtgttgagccacccatcagaccctctttagctgtgcaagataaaagcagcctgggtcacccaggccacaaggccatggttaattcttaaggcaaggcaaatccatggatgagaagtgcaatgggcatagtaaaagtgcatgaattta

SEQ ID NO: 368664 - DNA, 1318 bp, Homo sapiens
cgtctgttcgcagagctgtgggcggagttgaggccttggaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcaggtggcatcagaaatgggtcttatgacattggcatggcctgtggggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcagaatgtgaacactgatgacatggtataggagtgggtggggtgttgagccacccatcagaccctctttagctgtgcaagataaaagcagcctgggtcacccaggccacaaggccatggttaattcttaaggcaaggcaaatccatggatgagaagtgcaatgggcatagtaaaagtgcatgaattta

SEQ ID NO: 368665 - DNA, 1277 bp, Homo sapiens
gcggtctgttagtagtatagtgatgccagcagctaggactgggagagataggagaagtaggactgctgtgattgtggcatcagaaatgggtcttatgacattggcatggcctgtggggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcagggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggggtgttgagccacccatcagaccctctttagctgtgcaagataaaagcagcctgggtcacccaggccacaaggccatggttaattcttaaggcaaggcaaatccatggatgagaagtgcaatgggcatagtaaaagtgcatgaattta

SEQ ID NO: 368666 - DNA, 1647 bp, Homo sapiens
cgtctgttcgcagagctgtgggcggagttgaggccttggaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcagggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaccaccacggtccatgatgacaagggcaccaagaggagcatcactgtgacccaggatgagggtatccgccccagcaccaccatggagggcctggccaaactgaagcctgccttcaagaaagatggttctaccacagctggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcagggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggggtgttgagccacccatcagaccctctttagctgtgcaagataaaagcagcctgggtcacccaggccacaaggccatggttaattcttaaggcaaggcaaatccatggatgagaagtgcaatgggcatagtaaaagtgcatgaattta

SEQ ID NO: 368667 - DNA, 1176 bp, Homo sapiens
cgtctgttcgcagagctgtgggcggagttgaggccttggaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcaggtggcatcagaaatgggtcttatgacattggcatggcctgtggggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgagtgctggggcggataccctcatcctgggtcacagtgatgctcctcttggtgcccttgtcatcatggaccgtggtggtcacgggccagtacggatgtgcgggtgatgggaacgtggtgggggaagcagaggatgctggagccctcgaggagaacagacacaggctggggcagcaggggctgggggcggccacaatcactgctcaggttctccaaagacgtccgtcctgttgcgcttcatgttctcaaaggtcaaggccggccagccatgggttggagatgtcttgatgtcgtgccggtggctcacagtgtgtgtgcctcgtagaccggacagcaacctggtccacaacatataagggtctcc

SEQ ID NO: 368668 - DNA, 816 bp, Homo sapiens
cgtctgttcgcagagctgtgggcggagttgaggccttggaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcgtgacatcccggagactgtgcctttgtccactgtcaatagacagtgttcgtcggggctacaggcagtggccagcatagcagggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaagtgagtgctgattggggaggaatgtttaaagggctggagagtgaggttttgagtctatctaagtggtctgaagtggcaccatttcgtggttactgctgggcagtgagtgctttccaggccttgtgccacccaggttgggggtgggaagtaggaag

SEQ ID NO: 368669 - DNA, 177 bp, Homo sapiens
tgtggagaagctacgactcccccctgagaaggtgaaccccctggggggtgcagtggccttagggcacccactgggctgcactggggcacgacaggtcatcacgctgctcaatgagctgaagcgccgtgggaagaggtaaggctttgctcctggcggtggggtcatagggggatatcc

SEQ ID NO: 368670 - DNA, 505 bp, Homo sapiens
cgtctgttcgcagagctgtgggcggagttgaggccttggaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcgaaatgtcctgcctccgcgcagcctgcagcgggagaccctgtccccgccccagccgtcctcctggggtggaccctagtttaataaagattcaccaagtttcacgc

SEQ ID NO: 368671 - DNA, 1750 bp, Homo sapiens
  misc_feature (29)..(29): n is a, c, g, or t
  misc_feature (40)..(40): n is a, c, g, or t
ggacaccagggaactaagagactacaagntttgtccacanaaaagcacggcgttattatatactgaactgtgcatactaaacggtctaagggtacgagctgggttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcaggtggcatcagaaatgggtcttatgacattggcatggcctgtggggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcagggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggggtgttgagccacccatcagaccctctttagctgtgcaagataaaagcagcctgggtcacccaggccacaaggccatggttaattcttaaggcaaggcaaatccatggatgagaagtgcaatgggcatagtaaaagtgcatgaattta

SEQ ID NO: 368672 - DNA, 2033 bp, Homo sapiens
cgtctgttcgcagagctgtgggcggagttgaggccttggaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcaggtggcatcagaaatgggtcttatgacattggcatggcctgtggggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcagggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggggtgttgagccacccatcagaccctctttagctgtgcaagataaaagcagcctgggtcacccaggccacaaggccatggttaattcttaaggcaaggcaaatccatggatgagaagtgcaatgggcatagtaaaagtgcatgaatttaaaaaaaataaataaaaagagcgaagaaaaaaaatatattgggaaagaaagagaactaaaaaaaagtttatgaaaacgaatataaaggacagcaggaccacagtgttgatagtagacacaggtgaaaagaggagatcacaacaaggacaatacggaggagagaaagagggaaggaataccacacgaagaaaaaacacccggggagaaaccgagaagttcaacaacaacacagaagagctcgacagaaaaaggggaataaaaaaaaggacacaagaaaaagaataacaaacg

SEQ ID NO: 368673 - DNA, 2025 bp, Homo sapiens
cgtctgttcgcagagctgtgggcggagttgaggccttggaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcaggtggcatcagaaatgggtcttatgacattggcatggcctgtggggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcagaggtaaggtggctccttcatatagtatctgggtcccacctggatcctgcagctgccctgcatgctgttgccaggggcatgagggtggtcctgtgggtgctgcagagtggaggtggggcaggctagtgtcccatacttcaagcccttcctgaccccacagctgggattggctcacccttctggaagagacacacaccaggcagcctgtaggcccatggatggggtgggccccaggggaggcagagggccagtgtgtcagctcaggtctttaccttgtctgcagggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggggtgttgagccacccatcagaccctctttagctgtgcaagataaaagcagcctgggtcacccaggccacaaggccatggttaattcttaaggcaaggcaaatccatggatgagaagtgcaatgggcatagtaaaagtgcatgaattta

SEQ ID NO: 368674 - DNA, 2261 bp, Homo sapiens
cgtctgttcgcagagctgtgggcggagttgaggccttggaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcaggtggcatcagaaatgggtcttatgacattggcatggcctgtggggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcagggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaagagccttggccccggagccgcagggtgcaggacttctcaccgagcacaccttccaccaccatcgtggactcgtacagctcactactcctgtggggagcatgtgggggctgaggcctccctattccttgagacacaacaatattgaaattagaccaactgataaccctacaatagcctctaagtcttcaagtgaaaagaagagtcgtacgtatctcactttaaatcaaaatgattaagctaaaaaatgattaagcttagtgaggaaggcacattcaaagctgacacaggcagaaagctagctttgtgccaaacagacaaattgtgaaatgcaaagaaatgtaatatctagcaaatgccctatttgtgaaaattttgaagtaaaagataataaagcaaataaaatgttatgcaaacaaggaaaagaaaataggagaaagaaataatgtgatcaggttaactgataaaacagaggagaacaaaactgctgcttgaaatccctgcacaggttacgtgcaatgcaatccttaatgatggaatgagggcatcaaagggcgggggagctgagcaaagcactgctgaagatccattggcttagccaggtcagggctccagccccagagctcagagcaacacatggaagagtgggctgccccaggcacagaagtcaaatatcacatgatctcactcaagtgggtgctaaaaa

SEQ ID NO: 368675 - DNA, 1528 bp, Homo sapiens
cgtctgttcgcagagctgtgggcggagttgaggccttggaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcaggtggcatcagaaatgggtcttatgacattggcatggcctgtggggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggaaactctagccaggtgagtgatggggcagctgccatcctgctggcccggaggtccaaggcagaagagttgggccttcccatccttggggtcctgaggtcttatgcagtggttggggtcccacctggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggggtgttgagccacccatcagaccctctttagctgtgcaagataaaagcagcctgggtcacccaggccacaaggccatggttaattcttaaggcaaggcaaatccatggatgagaagtgcaatgggcatagtaaaagtgcatgaattta

SEQ ID NO: 368676 - DNA, 1700 bp, Homo sapiens
cgtctgttcgcagagctgtgggcggagttgaggccttggaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcagggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcagggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggggtgttgagccacccatcagaccctctttagctgtgcaagataaaagcagcctgggtcacccaggccacaaggccatggttaattcttaaggcaaggcaaatccatggatgagaagtgcaatgggcatagtaaaagtgcatgaattta

SEQ ID NO: 368677 - DNA, 1644 bp, Homo sapiens
cgtctgttcgcagagctgtgggcggagttgaggccttggaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcaggtggcatcagaaatgggtcttatgacattggcatggcctgtgggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcagggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggggtgttgagccacccatcagaccctctttagctgtgcaagataaaagcagcctgggtcacccaggccacaaggccatggttaattcttaaggcaaggcaaatccatggatgagaagtgcaatgggcatagtaaaagtgcatgaattta

SEQ ID NO: 368678 - DNA, 1868 bp, Homo sapiens
cgtctgttcgcagagctgtgggcggagttgaggccttggaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcagggtggagtccatgtccctggctgacagagggaaccctggaaatattacttcgcgcttgatggagaaggagaaggccagagattgcctgattcctatggggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctggtgagactggtccggggtaggggtatgagaaagcaggccatggccatgctgggtgctgtactctgggaacctggaatagaccaggcccctctgcaaagtagaagtgggagggctgggatctcctcatccccaccccgatgccttcttaccccaacagtttgcccctaggaaactctagccaggtgagtgatggggcagctgccatcctgctggcccggaggtccaaggcagaagagttgggccttcccatccttggggtcctgaggtcttatgcagtggttggggtcccacctgacatcatgggcattggacctgcctatgccatcccagtagctttgcaaaaagcagggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggggtgttgagccacccatcagaccctctttagctgtgcaagataaaagcagcctgggtcacccaggccacaaggccatggttaattcttaaggcaaggcaaatccatggatgagaagtgcaatgggcatagtaaaagtgcatgaattta

SEQ ID NO: 368679 - DNA, 1464 bp, Homo sapiens
cgtctgttcgcagagctgtgggcggagttgaggccttggaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcaggtggcatcagaaatgggtcttatgacattggcatggcctgtgggataacctctgagaatgtggctgagcggtttggcatttcacgggagaagcaggatacctttgccctggcttcccagcagaaggcagcaagagcccagagcaagggctgtttccaagctgagattgtgcctgtgaccaccacggtccatgatgacaagggcaccaagaggagcatcactgtgacccaggatgagggtatccgccccagcaccaccatggagggcctggccaaactgaagcctgccttcaagaaagatggttctaccacagctgggctgacagtgagtgacgtggacatcttcgagatcaatgaggcctttgcaagccaggctgcctactgtgtggagaagctacgactcccccctgagaaggtgaaccccctggggggtgcagtggccttagggcacccactgggctgcactggggcacgacaggtcatcacgctgctcaatgagctgaagcgccgtgggaagagggcatacggagtggtgtccatgtgcatcgggactggaatgggagccgctgccgtctttgaataccctgggaactgagtgaggtcccaggctggaggcgctacgcagacagtcctgctgctctagcagcaaggcagtaacaccacaaaagcaaaaccacatgggaaaactcagcactggtggtggtggcagtggacagatcaaggcacttcaactcatttggaaaatgtgaacactgatgacatggtataggagtgggtggggtgttgagccacccatcagaccctctttagctgtgcaagataaaagcagcctgggtcacccaggccacaaggccatggttaattcttaaggcaaggcaaatccatggatgagaagtgcaatgggcatagtaaaagtgcatgaattta

SEQ ID NO: 368680 - DNA, 646 bp, Homo sapiens
cgtctgttcgcagagctgtgggcggagttgaggccttggaggctgagatgtggttctgcgcgtgtgcggacggctgtctgttaactccgcggtcagttcccggactggtggctggtctgcagggttgacctgcgcaatgcagaggctgcaggtagtgctgggccacctgaggggtccggccgattccggctggatgccgcaggccgcgccttgcctgagcggtgccccgcaggcctcggccgcggacgtggtggtggtgcacgggcggcgcacggccatctgccgggcgggccgcggcggcttcaaggacaccacccccgacgagcttctctcggcagtcatgaccgcggttctcaaggacgtgaatctgaggccggaacagctgggggacatctgtgtcggaaatgtgctgcagcctggggccggggcaatcatggcccgaatcgcccagtttctgagtgacatcccggagactgtgcctttgtccactgtcaatagacagtgttcgtcggggctacaggcagtggccagcatagcaggtggcatcagaaatgggtcttatgacattggcatggcctgtgggtaagaatttttttctgccggagcttattaaccaacttgtgacaataaaactaattttcatctg

SEQ ID NO: 368681 - DNA, 662 bp, Homo sapiens
ttgcagtgagtcaagatcacgccactagactccagcctggtgacagagcgagacttcgtctcaaaaaaaaagaaatggccttttgttagatttaaaccgacatactgaaaaattacaaaacattgctgaaagaaattaaagacttaaataaatggaaagacatccatgttcatagattggaagacttaatattgttaagatggcaatactccaaatttatccacagattgaacacaatccctataaaaatcttacttgccattcttgcagaaattgacaagctgcttgtgaagttcatgtggaaattcaagggaatcacaataggcaaaaatgttggcaaaattgaataacttacacgccgtggttttaaagcctattacaaagctgtagtaatcaaaactgcacagtaataaaaactggcataaggagagatataggtcaatggaataaaatggagagttcagaaataaacacatctatttatcatcaattgattttcaaagagggtaccaagactattcagtggggaaagaatagtctccattcaacgaatggtgctgggaaaaggatatctacatgcaaaagaatgaggctgggcacctatttcacaccatgcacaaaagttaagtccaaatggttcaacaggcatgttagtgcagaag

SEQ ID NO: 368682 - DNA, 696 bp, Homo sapiens
ttgcagtgagtcaagatcacgccactagactccagcctggtgacagagcgagacttcgtctcaaaaaaaaagaaatggccttttgttagatttaaaccgacatactgaaaaattacaaaacattgctgaaagaaattaaagacttaaataaatggaaagacatccatgttcatagattggaagacttaatattgttaagatggcaatactccaaatttatccacagattgaacacaatccctataaaaatcttacttgccattcttgcagaaattgacaagctgcttgtgaagttcatgtggaaattcaagggaatcacaataggcaaaaatgttggcaaaattgaataacttacacgccgtggttttaaagcctattacaaagctgtagtaatcaaaactgcacagtaataaaaactggcataaggagagatataggtcaatggaataaaatggagagttcagaaataaacacatctatttatcatcaattgattttcaaagagggtaccaagactattcagtggggaaagaatagtctccattcaacgaatggtgctgggaaaaggatatctacatgcaaaagaatgaggctgggcacctatttcacaccatgcacaaaagaggctgggcacctatttcacaccatgcacaaaagttaagtccaaatggttcaacaggcatgttagtgcagaag

SEQ ID NO: 368683 - DNA, 373 bp, Homo sapiens
agttcaagctcttccctcccaaagtcacatgagtgaaatgtgtagctatactggtatcccttgacaggtaggcttaaaatcccttctttaggccaggcgcggtagctcacgcctgtaatcccagcactttgggagatcgaggcggatcacttgaggtcaggagttcgagaccagtctggccaacatggcaaaaccccgtctctactaaaaatgtaaaaatttagccgaacatggtggcgtatacctgtagtcccagctactctggaaactgaggcaggaaaatcacttgaacctgggaagtggaggttacagtgaactgagatcatgccactgtactccagcctgggcaacagagttagactctgtctcaaaa

SEQ ID NO: 368684 - DNA, 720 bp, Homo sapiens
  misc_feature (86)..(86): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatcca

SEQ ID NO: 368685 - DNA, 681 bp, Homo sapiens
  misc_feature (86)..(86): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatcca

SEQ ID NO: 368686 - DNA, 845 bp, Homo sapiens
  misc_feature (86)..(86): n is a, c, g, or t
  misc_feature (733)..(734): n is a, c, g, or t
  misc_feature (737)..(738): n is a, c, g, or t
  misc_feature (740)..(740): n is a, c, g, or t
  misc_feature (845)..(845): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatccaaaaaaaaaaaaaaaaaaaaaaaaaaaaaaaaaaaaaaaaaaattcggggggnnttnntnggggggggggaaaaaggggttgaaaggggccggggttgttttttctgcccccctttttttgttaaggggggaaaccggggggccccccaaggggggggcgaatan

SEQ ID NO: 368687 - DNA, 2362 bp, Homo sapiens
aactgaagaggcggcggagggccgaattcccttttctcaacggcttgatttcagagctgggctggtctctgacaggctcagctggagagggacgggttgggacgcactgtccttttgcccttccccctccgcgagcagaagctgactccgcaggagcgagggtcgcagagctgggggggatttcagtctccacatagttttggagccggacttttgaagaatgattcgtgaatccggaatgggtgacagcgtcatcacggcattttattggtaaagatgctttgtattggtcccggacctgctttaactttgtatttgccctgttgtgtggtcattatcttacaatacttgcgtgttgaggtgtgtttaaacactacgtgcttaacactggctaagtattggcattggggcggttggatttaggtattggtggcaatgtagaaaagtgatcaagtcagagccccttcacggactaatcacaagagaaacaacaaagctttacttgtgtgctgtgaaccacaactgcaagtggaattgtcaagagaactagccctgccaagctcaggaaaacttctgaggagatggcacatggaaaatggataagatttactgagacaaacgggagtagagaagtgtttttaattggcgataaggtgaataaaaaggcagggagaacagtagagtgatcatctgtctagagtagggggtgcatgtttgggtatagggctgtcatttaacctcttaaagaattgtctactggaactttcttcactcccatccccccaccccccaatgttgtatacaaaaccttagaggaagtgtatgcagaatgttggattttggaaaggctaatgtcgatggatcttggggaagaactgaagtagtagaaaatgaacctggataggatcagataataagatcaaatacagtagtgccttgaaagccagacaggaattctgatttgacttcatatagatgtgtgggaactgttatgggatctcaagcaaggtaatgataaaagtggtgacaatgaaagactgatgatggattagggaaaggggctaagattgggaacaagataagtagctataattgagaatgaaagtgaagcccacatctaagaggacaagtgtatatctttttaagaaatatgtcagaggccaggttggtggctcacacctgtaattccagcactttgggaggctgaggtgggtggatcatttgaggccaggaattcaagaccagcctggccaacatggtgaaaccccttctctactgaaaatacaataattagctgggcgtggtggcacatgcctatgatcccagctactggggaggctgaggcaggagaatcgttttaacccagaagacaggctgcagtgagccaagactgcaccactgcactccagcctgggcaacaaagtgagactctgcctcaaaaaataaatatgtgagaatttgatgataaagttaacaaagttaactttttagatgtaaaggtgatgttgaaggaagagtaaaagatgatgaaagttttttagtggggaaagaaaatgaaaaggaagaatggaattattactgagcaaaacagagtacagtagttggcaaagaaagattgaataagatgtgaagcgatgattagttttgaacttaatgagtttgacggaggttggaaatgcaggactgggttgcagctgtaatggtctgaagacagagatttaggagtcatatagaatgattattttcctatgtagaatgaatgattttcagaatctggggccacctactattggaacatgaggaaaaaaaaagaatcagtaaataaattggaactataaaaagtaaggaggagaaaagcccctaaaaaatggaatgtcagaggaaacaaggtcccagaaagtttagaggagtaaggatgaacaaacttgatgaacaaagtatttggccatggttttggcaaaaacaatgatcttcgaaagtacagtttctttgtagtgatagatggaagaaagagattgctgaagatttctagtaaaatatttattagtaactggaggcaataggtgtagacgacgtttccaggagattggtctcagaaggaatgagacgaattggatttaaacacaaatttttaatgttagaaatactagaatatgcttggcagtgaaagaaaaggatcctgtataggagtgattaaagatgatagagatgtgaagtacagcctggttgtggtggtgcacgcttgtagtcctagctactcgagaggctgaggtgggaggatcgcctgagcccagcaggtggaggctgcagtgatatcaggccactgcactccagcctggacaacagagtgagaccctgtctc

SEQ ID NO: 368688 - DNA, 583 bp, Homo sapiens
tcggacgcgtgggtcgacccacgcgtccgatgcagtgtggctctggatagcaccttatggacagttgtgtccccaaggaaggatgagaatagctactgaagtcctaaagagcaagcctaactcaagccattggcacacaggacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaaggactcagaattcatgattgaagaaatgccaggcagacctgttatcctaaactaagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatcca

SEQ ID NO: 368689 - DNA, 608 bp, Homo sapiens
  misc_feature (496)..(497): n is a, c, g, or t
  misc_feature (500)..(501): n is a, c, g, or t
  misc_feature (503)..(503): n is a, c, g, or t
  misc_feature (608)..(608): n is a, c, g, or t
aaggctaggtagcgaggctgggtgtggtcgactccggtggagtccaacttgcctggaccagcttaatggttctgctcctggtaacgtttttatccatggatgacttgcttgggtatggagagtcggcttgactacactgtgtggagcaagttttaaagaagcaaaggactcagaattcatgattgaagaaatgccaggcagacctgttatcctaaactaagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatccaaaaaaaaaaaaaaaaaaaaaaaaaaaaaaaaaaaaaaaaaaattcggggggnnttnntnggggggggggaaaaaggggttgaaaggggccggggttgttttttctgcccccctttttttgttaaggggggaaaccggggggccccccaaggggggggcgaatan

SEQ ID NO: 368690 - DNA, 1224 bp, Homo sapiens
  misc_feature (14)..(16): n is a, c, g, or t
  misc_feature (18)..(18): n is a, c, g, or t
  misc_feature (20)..(20): n is a, c, g, or t
  misc_feature (22)..(23): n is a, c, g, or t
  misc_feature (25)..(25): n is a, c, g, or t
  misc_feature (27)..(27): n is a, c, g, or t
  misc_feature (29)..(31): n is a, c, g, or t
gcgtcgacgcttgnnngngncnngncncnnncaagcagtaagctgcatgcttgcttgttgtggtcattaaaaaccctagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatccaaaaaaaaaaaaaaaaaaaaaaaaaaaaaaaaaaaaaaaaaaaaaaaaaaacaaaaaacaaaaaaaaaaaaggggggggggccaaaaacactctcaagaggggccacaatagagaaacagaaacacgagacaacggagccccaaaagaggaggcgccaagatcaaaccgcacggaagcgcacaaaacaaaaaacaagcaaaaacagagcaaaacagggaaaaccagaaaaacacagcagagaacacacacaaaaacagagggagaaacaaaaacaagagacacacacaaaacaaaaagaaaacaccagacaacaggaacaaacaacaaacagtaacagagcaaaaaaagagataaaacaaaaagacaccaccaaaggcgacaaaaaggaaacacaactaaccagcacgcacagagcaccacgccgccacgcgggaacacaacatagaaaacgacggcgaccagagagaccacaggaaacgcaagcaaacaacacaaacagcagaacacgcacgaaacaaaaagacacaacgcagagagaacaccacaaacgcgagaaagacgagaaggagaacagagaagaagaagagaaaaaaagaaaacaaaaggaaaaggagaaaagaaaagaggaaacaaaaccagaagagaacaagagaagacgaacgagaccaacagcaagcagacagagcaaggcaagggggaaaggcggagggagagacgagagaagagcggaaggcgagggagactaggagttatagaacaacgagagagagcaagggaacagaggcgaaggggagaagggggcgagagcgcacagaggaaaaaggaggagagggcaagcgcagaggcaaagagacaggagaaaggcagaaggaaggcaaaaggaggaagagagaaggggaaacaggaagagtgagaaggaggg

SEQ ID NO: 368691 - DNA, 221 bp, Homo sapiens
  misc_feature (14)..(16): n is a, c, g, or t
  misc_feature (18)..(18): n is a, c, g, or t
  misc_feature (20)..(20): n is a, c, g, or t
  misc_feature (22)..(23): n is a, c, g, or t
  misc_feature (25)..(25): n is a, c, g, or t
  misc_feature (27)..(27): n is a, c, g, or t
  misc_feature (29)..(31): n is a, c, g, or t
gcgtcgacgcttgnnngngncnngncncnnncaagcagtaagctgcatgcttgcttgttgtggtcattaaaaaccctgcctttgaagcttactacagcctcaaacttctgggctcaagtgatcctcagcctcccagtggtctttgtagactgcctgatggagtctcatggcacaagaagattaaaacagtgtctccaattttaataaatttttgcaatcca

SEQ ID NO: 368692 - DNA, 673 bp, Homo sapiens
  misc_feature (24)..(25): n is a, c, g, or t
ggggctttttctttgtacgagtcnnctcctgtgaggtatggtgctgggtgcagatgcagtgtggctctggatagcaccttatggacagttgtgtccccaaggaaggatgagaatagctactgaagtcctaaagagcaagcctaactcaagccattggcacacaggacaggcattagacagaaagctggaagttgaaatggtaagtgaaactgtatccaagtaagcggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgccaggcagacctgttatcctaaactaagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatcca

SEQ ID NO: 368693 - DNA, 899 bp, Homo sapiens
  misc_feature (203)..(203): n is a, c, g, or t
ggatgaattaggcaaaagtataaaaatttttattttatctgaaattaatgacgacaaagacaaaatataccagaatttttgggacatagctaagcagggttaagaagaaagtctgttgtgctaaacacctacatcaaaaagttagatctcaaattaacctaatgatgcacctacaggaactggccagttcctgcttcttgagnggcttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaaggactcagaattcatgattgaagaaatgccaggcagacctgttatcctaaactaagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgaggaagcctaatggcccaggaggttaaaaagggggtctccaatttaaaaaattttgcgatcccaaaaaaaaaattctctcccaactcgggggaaaactactcttaaaaaactttgtggccctttgccccaacctttttaacattggcttttttgccg

SEQ ID NO: 368694 - DNA, 647 bp, Homo sapiens
aaggctaggtagcgaggctgggtgtggtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgccaggcagacctgttatcctaaactaagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatcca

SEQ ID NO: 368695 - DNA, 358 bp, Homo sapiens
  misc_feature (24)..(25): n is a, c, g, or t
ggggctttttctttgtacgagtcnnctcctgtgaggtatggtgctgggtgcagatgcagtgtggctctggatagcaccttatggacagttgtgtccccaaggaaggatgagaatagctactgaagtcctaaagagcaagcctaactcaagccattggcacacaggacaggcattagacagaaagctggaagttgaaatggtaggtaaactttatccaggtaggcaggtacctggcaacctcctcggacacatatggcttttaggtacctcctaggcctgatgacttaataaaatgcacagttctcttctgtaagtgttaatgagaaagttgtaaatcacagctgagtagtgtacgcat

SEQ ID NO: 368696 - DNA, 790 bp, Homo sapiens
  misc_feature (14)..(15): n is a, c, g, or t
cggccgccaacttnntttttcgaggtaggagtcgactcctgtgaggtatggtgctgggtgcagatgcagtgtggctctggatagcaccttatggacaggttgtgtccccaaggaaggatgagaatagctactgaagtcctaaagagcaagcctaactcaagccattggcacacaggacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaaggactcagaattcatgattgaagaaatgcaggttagtttaaactttgaaggaaatttttaaggtggcaaaaggttttggtggcatatacaccttaatctgtagatgggagtgattagctgtttaaaagttaaaatgtgactgagaaggaaattgagtagggcaaattttaaatgggtattatttttcatcttcaaacaggcagacctgttatcctaaactaagggtttttaatgaccacaacaagcaagcatgcagcttactgcttgaaagggtcttgcctcacccaagctagagtgcagtgggcttttgaagctttactacaagcctcaaaacttctgggttcaaagtgaatccttcagctccagtggttttgtgactgctgatggagtctccatggcccagcagcgattcacccggtcttccattttcatacattttggcatccagaac

SEQ ID NO: 368697 - DNA, 816 bp, Homo sapiens
  misc_feature (203)..(203): n is a, c, g, or t
ggatgaattaggcaaaagtataaaaatttttattttatctgaaattaatgacgacaaagacaaaatataccagaatttttgggacatagctaagcagggttaagaagaaagtctgttgtgctaaacacctacatcaaaaagttagatctcaaattaacctaatgatgcacctacaggaactggccagttcctgcttcttgagnggcttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgcagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatcca

SEQ ID NO: 368698 - DNA, 868 bp, Homo sapiens
tactgtcttttcgaggtaggagtcgactcctgtgaggtatgttttatctttgcgaatgttgcgggttttggggcgctccagcctttgtctgctaaggtcaccctgaattgactgggacttctaagccagtcgcgcgcctttgcagggcctacaagttgaggatggtgggggattgcacatatggtgcatgcgtgacctaagctgcgactatgttagagtagaactgcggagaagcctcggctctcgtgccctgcctctgatgaagcctgtgttgatgcagtgtggctctggatagcaccttatggacaggttgtgtccccaaggaaggatgagaatagctactgaagtcctaaagagcaagcctaactcaagccattggcacacaggacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgccaggcagacctgttatcctaaactaagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatcca

SEQ ID NO: 368699 - DNA, 1642 bp, Homo sapiens
  misc_feature (86)..(86): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatccaaaaaaaaaaaaaaaaaaaaaaaaaaaaaaaaaaaaaaaaaaaaaaaaaaacaaaaaacaaaaaaaaaaaaggggggggggccaaaaacactctcaagaggggccacaatagagaaacagaaacacgagacaacggagccccaaaagaggaggcgccaagatcaaaccgcacggaagcgcacaaaacaaaaaacaagcaaaaacagagcaaaacagggaaaaccagaaaaacacagcagagaacacacacaaaaacagagggagaaacaaaaacaagagacacacacaaaacaaaaagaaaacaccagacaacaggaacaaacaacaaacagtaacagagcaaaaaaagagataaaacaaaaagacaccaccaaaggcgacaaaaaggaaacacaactaaccagcacgcacagagcaccacgccgccacgcgggaacacaacatagaaaacgacggcgaccagagagaccacaggaaacgcaagcaaacaacacaaacagcagaacacgcacgaaacaaaaagacacaacgcagagagaacaccacaaacgcgagaaagacgagaaggagaacagagaagaagaagagaaaaaaagaaaacaaaaggaaaaggagaaaagaaaagaggaaacaaaaccagaagagaacaagagaagacgaacgagaccaacagcaagcagacagagcaaggcaagggggaaaggcggagggagagacgagagaagagcggaaggcgagggagactaggagttatagaacaacgagagagagcaagggaacagaggcgaaggggagaagggggcgagagcgcacagaggaaaaaggaggagagggcaagcgcagaggcaaagagacaggagaaaggcagaaggaaggcaaaaggaggaagagagaaggggaaacaggaagagtgagaaggaggg

SEQ ID NO: 368700 - DNA, 1031 bp, Homo sapiens
  misc_feature (86)..(86): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatccaaaaaaaaaaaaaaaaaaaaaaaaaaaaaaaaaaaaaaaaaaagggggggggctaaaaattcccccggggggccccagtttatcgcgctatccccggtcttttacgtgcaacaagggggcccccaataggggggagggcggttttataaagcaagaggcacggccgcgcgtttaaaccccgcttctggggtcgtgggaaagcctgggtgctgggacttcttcgggaaagagcccctacctttgtgtgggcgttgagctctttttgcgacccctatccctacaagagattttacgaggtccaaggcggacatttaaaccttccagcttgttttgtgctgtatcgccccgcgt

SEQ ID NO: 368701 - DNA, 1896 bp, Homo sapiens
  misc_feature (86)..(86): n is a, c, g, or t
  misc_feature (1643)..(1643): n is a, c, g, or t
  misc_feature (1704)..(1704): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatccatctggagtgtgtagtgtttacttaaaaaaggacagtgcttttcatctgttcattagctgtaagcataaatcacattcaaaagctattataactccatggtatttgcttcattaacactgcagccagttaaaattttatgggtattttacaaggtgtcttatgcattaaagtgcaatatttcctaattctccatatgagcaaattgtcaggtttcataggcccctgtgctaattggttttgagcttaaagtattgatggagctacttggagaaagtcatgttgagtctgaggctgggaaaataagttatagaaaatactatagaaatgcccaactagtgataggcattaatggaattgggaaaatctacaatccatagccatggtgataggtttttggcaagcactaagtgtttagggatgccaaaagtgggtataaagggcacaactggtttaaggcaatctgtcccagggaaacaggaccaaggggccaaaattccaagatgggtcaaattttaatttcagtgtcagtacagctgtgcttataatgatgtctttgttagcagtaatggttttacaaatctgtttctgggctaaagcactttagtcccattaatgataaaacttcagttactctctgaattttcctttttttgagactgaatcctgttgccccaggaggttgaggatgcagtgagctgtgtcacaccactggattccagcctgggtgacagggtgagatgttgtctcaaataaaatattaaaaattggatcaccttattcagcattctgttgtttagcagttttggaattttagttgttagtaaatcttgaccttgagtacacgttattttgatattctgtgtgacaaaatgggaagtatgcatgaagcacatctgccataaagtatggatgtctagattttnttttccctagaaaaagtagttacaattgtttgagatacaagctgaactagctgcttgtttncacagaacatttttagtttgaaaaaacctgacaaattgattattcatattttaggggtaattttggcagagatttgctcaaaaaagaacaagtcagcttggaaaaaactgatggcatttgttgccaatgataaaactcaagcttccaaatgaaacctaaaattttggaaggcttgtatacacttctgtgccc

SEQ ID NO: 368702 - DNA, 2424 bp, Homo sapiens
  misc_feature (86)..(86): n is a, c, g, or t
  misc_feature (2171)..(2171): n is a, c, g, or t
  misc_feature (2232)..(2232): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgcaggttagtttaaactttgaaggaaatttttaaggtggcaaaaggttttggtggcatatacaccttaatctgtagatgggagtgattagctgtttaaaagttaaaatgtgactgagaaggaaattgagtagggcaaattttaaatgggtattatttttcatcttcaaacaggcagacctgttatcctaaactaggtgagtcagcttttggtacatgtgatgattttcagtgtaaccaatgatgtaatgattctgccaaatgaaatataatgatatcactgtaaaaccgttccattttgattctgaggttactctactaacaagcatcacacatttgtattttgccctgattaatatgttggcttcgctttcagggtttttaatgaccacaacaagcaagcatgcagcttactgcttgaaaggtgaggattggaaatgttgggactattataattgcagaatacatgatgatctcaatccaacttgaactctctcactgattacttgatgacaataaaatatctgatattctgcattcccatgtagcattttaattgaagtctgtaaatgtggctaaaagtcttgtcttattttttgagacagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatccatctggagtgtgtagtgtttacttaaaaaaggacagtgcttttcatctgttcattagctgtaagcataaatcacattcaaaagctattataactccatggtatttgcttcattaacactgcagccagttaaaattttatgggtattttacaaggtgtcttatgcattaaagtgcaatatttcctaattctccatatgagcaaattgtcaggtttcataggcccctgtgctaattggttttgagcttaaagtattgatggagctacttggagaaagtcatgttgagtctgaggctgggaaaataagttatagaaaatactatagaaatgcccaactagtgataggcattaatggaattgggaaaatctacaatccatagccatggtgataggtttttggcaagcactaagtgtttagggatgccaaaagtgggtataaagggcacaactggtttaaggcaatctgtcccagggaaacaggaccaaggggccaaaattccaagatgggtcaaattttaatttcagtgtcagtacagctgtgcttataatgatgtctttgttagcagtaatggttttacaaatctgtttctgggctaaagcactttagtcccattaatgataaaacttcagttactctctgaattttcctttttttgagactgaatcctgttgccccaggaggttgaggatgcagtgagctgtgtcacaccactggattccagcctgggtgacagggtgagatgttgtctcaaataaaatattaaaaattggatcaccttattcagcattctgttgtttagcagttttggaattttagttgttagtaaatcttgaccttgagtacacgttattttgatattctgtgtgacaaaatgggaagtatgcatgaagcacatctgccataaagtatggatgtctagattttnttttccctagaaaaagtagttacaattgtttgagatacaagctgaactagctgcttgtttncacagaacatttttagtttgaaaaaacctgacaaattgattattcatattttaggggtaattttggcagagatttgctcaaaaaagaacaagtcagcttggaaaaaactgatggcatttgttgccaatgataaaactcaagcttccaaatgaaacctaaaattttggaaggcttgtatacacttctgtgccc

SEQ ID NO: 368703 - DNA, 1248 bp, Homo sapiens
  misc_feature (86)..(86): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgcaggttagtttaaactttgaaggaaatttttaaggtggcaaaaggttttggtggcatatacaccttaatctgtagatgggagtgattagctgtttaaaagttaaaatgtgactgagaaggaaattgagtagggcaaattttaaatgggtattatttttcatcttcaaacaggcagacctgttatcctaaactaggtgagtcagcttttggtacatgtgatgattttcagtgtaaccaatgatgtaatgattctgccaaatgaaatataatgatatcactgtaaaaccgttccattttgattctgaggttactctactaacaagcatcacacatttgtattttgccctgattaatatgttggcttcgctttcagggtttttaatgaccacaacaagcaagcatgcagcttactgcttgaaaggtgaggattggaaatgttgggactattataattgcagaatacatgatgatctcaatccaacttgaactctctcactgattacttgatgacaataaaatatctgatattctgcattcccatgtagcattttaattgaagtctgtaaatgtggctaaaagtcttgtcttattttttgagacagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatcca

SEQ ID NO: 368704 - DNA, 1067 bp, Homo sapiens
  misc_feature (86)..(86): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgcaggttagtttaaactttgaaggaaatttttaaggtggcaaaaggttttggtggcatatacaccttaatctgtagatgggagtgattagctgtttaaaagttaaaatgtgactgagaaggaaattgagtagggcaaattttaaatgggtattatttttcatcttcaaacaggcagacctgttatcctaaactaggtgagtcagcttttggtacatgtgatgattttcagtgtaaccaatgatgtaatgattctgccaaatgaaatataatgatatcactgtaaaaccgttccattttgattctgaggttactctactaacaagcatcacacatttgtattttgccctgattaatatgttggcttcgctttcagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatcca

SEQ ID NO: 368705 - DNA, 1591 bp, Homo sapiens
  misc_feature (86)..(86): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggtatagcagttccaagtattttttttttttttttagacaagagtctagctcttgcccagaatggagtgcagcggcactatcagttcactgcaacctctgcctcccaggttcaaggaattctcctgcctcagcctcttgagtagctgggattacaggcatgtgacaccatgcctggctaattttgtacagctatgttgtccaggctggtctcgaactcttgacctcaagtgatactgcccgcactgacctcccaaagtgctgggattacaggcgtgagccaccatgccccgcctcaagtctggtttttaagtgttgtaaagccgatacaatgatgataacatagttcagcagactaacgctgatgagcaatattaagtctttcgctcctatctgatgtatctggcggtaacattctagtttatgccccgaaaaggggaatatagccattctataatgtttggagattttggattactcctaattgtatgcaagttgtcttactgtgtattgtcccttaatttcaggactcagaattcatgattgaagaaatgcaggttagtttaaactttgaaggaaatttttaaggtggcaaaaggttttggtggcatatacaccttaatctgtagatgggagtgattagctgtttaaaagttaaaatgtgactgagaaggaaattgagtagggcaaattttaaatgggtattatttttcatcttcaaacaggcagacctgttatcctaaactaggtgagtcagcttttggtacatgtgatgattttcagtgtaaccaatgatgtaatgattctgccaaatgaaatataatgatatcactgtaaaaccgttccattttgattctgaggttactctactaacaagcatcacacatttgtattttgccctgattaatatgttggcttcgctttcagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatcca

SEQ ID NO: 368706 - DNA, 1873 bp, Homo sapiens
  misc_feature (86)..(86): n is a, c, g, or t
  misc_feature (1620)..(1620): n is a, c, g, or t
  misc_feature (1681)..(1681): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgcagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatccatctggagtgtgtagtgtttacttaaaaaaggacagtgcttttcatctgttcattagctgtaagcataaatcacattcaaaagctattataactccatggtatttgcttcattaacactgcagccagttaaaattttatgggtattttacaaggtgtcttatgcattaaagtgcaatatttcctaattctccatatgagcaaattgtcaggtttcataggcccctgtgctaattggttttgagcttaaagtattgatggagctacttggagaaagtcatgttgagtctgaggctgggaaaataagttatagaaaatactatagaaatgcccaactagtgataggcattaatggaattgggaaaatctacaatccatagccatggtgataggtttttggcaagcactaagtgtttagggatgccaaaagtgggtataaagggcacaactggtttaaggcaatctgtcccagggaaacaggaccaaggggccaaaattccaagatgggtcaaattttaatttcagtgtcagtacagctgtgcttataatgatgtctttgttagcagtaatggttttacaaatctgtttctgggctaaagcactttagtcccattaatgataaaacttcagttactctctgaattttcctttttttgagactgaatcctgttgccccaggaggttgaggatgcagtgagctgtgtcacaccactggattccagcctgggtgacagggtgagatgttgtctcaaataaaatattaaaaattggatcaccttattcagcattctgttgtttagcagttttggaattttagttgttagtaaatcttgaccttgagtacacgttattttgatattctgtgtgacaaaatgggaagtatgcatgaagcacatctgccataaagtatggatgtctagattttnttttccctagaaaaagtagttacaattgtttgagatacaagctgaactagctgcttgtttncacagaacatttttagtttgaaaaaacctgacaaattgattattcatattttaggggtaattttggcagagatttgctcaaaaaagaacaagtcagcttggaaaaaactgatggcatttgttgccaatgataaaactcaagcttccaaatgaaacctaaaattttggaaggcttgtatacacttctgtgccc

SEQ ID NO: 368707 - DNA, 1778 bp, Homo sapiens
  misc_feature (86)..(86): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaagtacatgttttattgatgttaacgttaattgattgagctactgttagtgatgattttaaaattaaagcagatgggaatctctctgagaaagaaaatggagattaatcttaaactgaaacagtagttgggaaatcttttagaaatccacctattactacctattggtaaaggagattaaatttctacaggtatggagagtcggcttgactacactgtgtggagcaagttttaaagaagcaaaggtatagcagttccaagtattttttttttttttttagacaagagtctagctcttgcccagaatggagtgcagcggcactatcagttcactgcaacctctgcctcccaggttcaaggaattctcctgcctcagcctcttgagtagctgggattacaggcatgtgacaccatgcctggctaattttgtacagctatgttgtccaggctggtctcgaactcttgacctcaagtgatactgcccgcactgacctcccaaagtgctgggattacaggcgtgagccaccatgccccgcctcaagtctggtttttaagtgttgtaaagccgatacaatgatgataacatagttcagcagactaacgctgatgagcaatattaagtctttcgctcctatctgatgtatctggcggtaacattctagtttatgccccgaaaaggggaatatagccattctataatgtttggagattttggattactcctaattgtatgcaagttgtcttactgtgtattgtcccttaatttcaggactcagaattcatgattgaagaaatgcaggttagtttaaactttgaaggaaatttttaaggtggcaaaaggttttggtggcatatacaccttaatctgtagatgggagtgattagctgtttaaaagttaaaatgtgactgagaaggaaattgagtagggcaaattttaaatgggtattatttttcatcttcaaacaggcagacctgttatcctaaactaggtgagtcagcttttggtacatgtgatgattttcagtgtaaccaatgatgtaatgattctgccaaatgaaatataatgatatcactgtaaaaccgttccattttgattctgaggttactctactaacaagcatcacacatttgtattttgccctgattaatatgttggcttcgctttcagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatcca

SEQ ID NO: 368708 - DNA, 2948 bp, Homo sapiens
  misc_feature (86)..(86): n is a, c, g, or t
  misc_feature (2695)..(2695): n is a, c, g, or t
  misc_feature (2756)..(2756): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggtatagcagttccaagtattttttttttttttttagacaagagtctagctcttgcccagaatggagtgcagcggcactatcagttcactgcaacctctgcctcccaggttcaaggaattctcctgcctcagcctcttgagtagctgggattacaggcatgtgacaccatgcctggctaattttgtacagctatgttgtccaggctggtctcgaactcttgacctcaagtgatactgcccgcactgacctcccaaagtgctgggattacaggcgtgagccaccatgccccgcctcaagtctggtttttaagtgttgtaaagccgatacaatgatgataacatagttcagcagactaacgctgatgagcaatattaagtctttcgctcctatctgatgtatctggcggtaacattctagtttatgccccgaaaaggggaatatagccattctataatgtttggagattttggattactcctaattgtatgcaagttgtcttactgtgtattgtcccttaatttcaggactcagaattcatgattgaagaaatgcaggttagtttaaactttgaaggaaatttttaaggtggcaaaaggttttggtggcatatacaccttaatctgtagatgggagtgattagctgtttaaaagttaaaatgtgactgagaaggaaattgagtagggcaaattttaaatgggtattatttttcatcttcaaacaggcagacctgttatcctaaactaggtgagtcagcttttggtacatgtgatgattttcagtgtaaccaatgatgtaatgattctgccaaatgaaatataatgatatcactgtaaaaccgttccattttgattctgaggttactctactaacaagcatcacacatttgtattttgccctgattaatatgttggcttcgctttcagggtttttaatgaccacaacaagcaagcatgcagcttactgcttgaaaggtgaggattggaaatgttgggactattataattgcagaatacatgatgatctcaatccaacttgaactctctcactgattacttgatgacaataaaatatctgatattctgcattcccatgtagcattttaattgaagtctgtaaatgtggctaaaagtcttgtcttattttttgagacagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatccatctggagtgtgtagtgtttacttaaaaaaggacagtgcttttcatctgttcattagctgtaagcataaatcacattcaaaagctattataactccatggtatttgcttcattaacactgcagccagttaaaattttatgggtattttacaaggtgtcttatgcattaaagtgcaatatttcctaattctccatatgagcaaattgtcaggtttcataggcccctgtgctaattggttttgagcttaaagtattgatggagctacttggagaaagtcatgttgagtctgaggctgggaaaataagttatagaaaatactatagaaatgcccaactagtgataggcattaatggaattgggaaaatctacaatccatagccatggtgataggtttttggcaagcactaagtgtttagggatgccaaaagtgggtataaagggcacaactggtttaaggcaatctgtcccagggaaacaggaccaaggggccaaaattccaagatgggtcaaattttaatttcagtgtcagtacagctgtgcttataatgatgtctttgttagcagtaatggttttacaaatctgtttctgggctaaagcactttagtcccattaatgataaaacttcagttactctctgaattttcctttttttgagactgaatcctgttgccccaggaggttgaggatgcagtgagctgtgtcacaccactggattccagcctgggtgacagggtgagatgttgtctcaaataaaatattaaaaattggatcaccttattcagcattctgttgtttagcagttttggaattttagttgttagtaaatcttgaccttgagtacacgttattttgatattctgtgtgacaaaatgggaagtatgcatgaagcacatctgccataaagtatggatgtctagattttnttttccctagaaaaagtagttacaattgtttgagatacaagctgaactagctgcttgtttncacagaacatttttagtttgaaaaaacctgacaaattgattattcatattttaggggtaattttggcagagatttgctcaaaaaagaacaagtcagcttggaaaaaactgatggcatttgttgccaatgataaaactcaagcttccaaatgaaacctaaaattttggaaggcttgtatacacttctgtgccc

SEQ ID NO: 368709 - DNA, 1895 bp, Homo sapiens
  misc_feature (86)..(86): n is a, c, g, or t
  misc_feature (1642)..(1642): n is a, c, g, or t
  misc_feature (1703)..(1703): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgcaggcagacctgttatcctaaacagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatccatctggagtgtgtagtgtttacttaaaaaaggacagtgcttttcatctgttcattagctgtaagcataaatcacattcaaaagctattataactccatggtatttgcttcattaacactgcagccagttaaaattttatgggtattttacaaggtgtcttatgcattaaagtgcaatatttcctaattctccatatgagcaaattgtcaggtttcataggcccctgtgctaattggttttgagcttaaagtattgatggagctacttggagaaagtcatgttgagtctgaggctgggaaaataagttatagaaaatactatagaaatgcccaactagtgataggcattaatggaattgggaaaatctacaatccatagccatggtgataggtttttggcaagcactaagtgtttagggatgccaaaagtgggtataaagggcacaactggtttaaggcaatctgtcccagggaaacaggaccaaggggccaaaattccaagatgggtcaaattttaatttcagtgtcagtacagctgtgcttataatgatgtctttgttagcagtaatggttttacaaatctgtttctgggctaaagcactttagtcccattaatgataaaacttcagttactctctgaattttcctttttttgagactgaatcctgttgccccaggaggttgaggatgcagtgagctgtgtcacaccactggattccagcctgggtgacagggtgagatgttgtctcaaataaaatattaaaaattggatcaccttattcagcattctgttgtttagcagttttggaattttagttgttagtaaatcttgaccttgagtacacgttattttgatattctgtgtgacaaaatgggaagtatgcatgaagcacatctgccataaagtatggatgtctagattttnttttccctagaaaaagtagttacaattgtttgagatacaagctgaactagctgcttgtttncacagaacatttttagtttgaaaaaacctgacaaattgattattcatattttaggggtaattttggcagagatttgctcaaaaaagaacaagtcagcttggaaaaaactgatggcatttgttgccaatgataaaactcaagcttccaaatgaaacctaaaattttggaaggcttgtatacacttctgtgccc

SEQ ID NO: 368710 - DNA, 2576 bp, Homo sapiens
  misc_feature (86)..(86): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaggggatttcagtctccacatagttttggagccggacttttgaagaatgattcgtgaatccggaatgggtgacagcgtcatcacggcattttattgacagaccatggattcttacagtgcaccagagtcaactcctagtgcatcctcaagacctgaagattactttataggtgccactcctctgcagaaacgattagaatcggtcaggaagcagagttcatttatcctgactccacctcgaaggaaaattccccagtgttcgcagttgcaggaagatgttgaccctcaaaaggttgcattccttctgcataaacagtggactttatatagtttaactcccttatataaattctcctatagtaatctcaaagagtattctagacttctcaatgcttttattgttgctgaaaagcaaaaaggacttgctgtggaagtgggagaagacttcaacatcaaagtgattttttctactctcctaggaatgaaaggaacacaaagggacccggaagcatttcttgtccagattgtgtcaaaatctcaattgccatctgagaatagagaaggtaaagtgctgtggactggctggttctgctgtgtatttggagacagtcttctggagactgtttcagaagatttcacctgtctgcccttattccttgcaaatggagcagagtctaacacagcaataattggaacttggtttcagaaaacctttgactgttatttcagtcctttagcaatcaatgcatttaatctttcctggatggctgccatgtggactgcatgcaaaatggaccattatgtggctactactgaatttctttggtctgtaccctgtagccctcaaagtctggacatttctttcgcaatacatccagaggatgcaaaagctctatgggacagtgtccacaaaacacctggggaggttacccaggaagaagttgacctattcatggattgcctttattcacatttccatagacatttcaaaattcatttatcagccacaagattagttcgtgtttcaacatctgtagcttcagcacatactgatggaaaaataaagattctgtgtcataaataccttattggagtgttagcatatttgacagaactggcaatttttcaaattgagtgaagccttatgtggactataagttatagattatatactcttattgataacttgcctaattgctatgctgaaagagactgcaggagaaataggcatctatctctgcatctgttttccccaccatgcctttggagttgccaagatggaagccaagaaggatctagaagaacaaagaatatggtagtagatgagccacagccaggtgcccatgtactaatcatgataacctgacatgccattctcaaaatgctgagttgttaatttcttgtcatctttaaatatatatatataggctgggcttggtggctcacacctgtaattccagcactttgggaggctgaggtgggtggatcatttgaggccaggaattcaagaccagcctggccaacatggtgaaaccccttctctactgaaaatacaataattagctgggcgtggtggcacatgcctatgatcccagctactggggaggctgaggcaggagaatcgttttaacccagaagacaggctgcagtgagccaagactgcaccactgcactccagcctgggcaacaaagtgagactctgcctcaaaaaataaaaaagaaataaaataaataaatacagcgtttattatgtttaaactcttaggattcaaatgagatgtatctaatggatatttctgatttgggtctttaaaacctttaatctcttttaagcattttagacttgcattcagaaagaattctgtcttctaaagacattttcctagcatttcactgcggagaactggcaatcaaaatcccctcaaaagggaactaaagattaatatacacatttttttagtcattaatatgcttctgttttaaatacagttcaactcctgttgcaatgttgaattaaatgtttattttaaaatg

SEQ ID NO: 368711 - DNA, 2065 bp, Homo sapiens
  misc_feature (86)..(86): n is a, c, g, or t
  misc_feature (1812)..(1812): n is a, c, g, or t
  misc_feature (1873)..(1873): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgcaggttagtttaaactttgaaggaaatttttaaggtggcaaaaggttttggtggcatatacaccttaatctgtagatgggagtgattagctgtttaaaagttaaaatgtgactgagaaggaaattgagtagggcaaattttaaatgggtattatttttcatcttcaaacaggcagacctgttatcctaaactaagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatccatctggagtgtgtagtgtttacttaaaaaaggacagtgcttttcatctgttcattagctgtaagcataaatcacattcaaaagctattataactccatggtatttgcttcattaacactgcagccagttaaaattttatgggtattttacaaggtgtcttatgcattaaagtgcaatatttcctaattctccatatgagcaaattgtcaggtttcataggcccctgtgctaattggttttgagcttaaagtattgatggagctacttggagaaagtcatgttgagtctgaggctgggaaaataagttatagaaaatactatagaaatgcccaactagtgataggcattaatggaattgggaaaatctacaatccatagccatggtgataggtttttggcaagcactaagtgtttagggatgccaaaagtgggtataaagggcacaactggtttaaggcaatctgtcccagggaaacaggaccaaggggccaaaattccaagatgggtcaaattttaatttcagtgtcagtacagctgtgcttataatgatgtctttgttagcagtaatggttttacaaatctgtttctgggctaaagcactttagtcccattaatgataaaacttcagttactctctgaattttcctttttttgagactgaatcctgttgccccaggaggttgaggatgcagtgagctgtgtcacaccactggattccagcctgggtgacagggtgagatgttgtctcaaataaaatattaaaaattggatcaccttattcagcattctgttgtttagcagttttggaattttagttgttagtaaatcttgaccttgagtacacgttattttgatattctgtgtgacaaaatgggaagtatgcatgaagcacatctgccataaagtatggatgtctagattttnttttccctagaaaaagtagttacaattgtttgagatacaagctgaactagctgcttgtttncacagaacatttttagtttgaaaaaacctgacaaattgattattcatattttaggggtaattttggcagagatttgctcaaaaaagaacaagtcagcttggaaaaaactgatggcatttgttgccaatgataaaactcaagcttccaaatgaaacctaaaattttggaaggcttgtatacacttctgtgccc

SEQ ID NO: 368712 - DNA, 1898 bp, Homo sapiens
  misc_feature (86)..(86): n is a, c, g, or t
  misc_feature (1645)..(1645): n is a, c, g, or t
  misc_feature (1706)..(1706): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgccaggcagacctgttatcctaaactaagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatccatctggagtgtgtagtgtttacttaaaaaaggacagtgcttttcatctgttcattagctgtaagcataaatcacattcaaaagctattataactccatggtatttgcttcattaacactgcagccagttaaaattttatgggtattttacaaggtgtcttatgcattaaagtgcaatatttcctaattctccatatgagcaaattgtcaggtttcataggcccctgtgctaattggttttgagcttaaagtattgatggagctacttggagaaagtcatgttgagtctgaggctgggaaaataagttatagaaaatactatagaaatgcccaactagtgataggcattaatggaattgggaaaatctacaatccatagccatggtgataggtttttggcaagcactaagtgtttagggatgccaaaagtgggtataaagggcacaactggtttaaggcaatctgtcccagggaaacaggaccaaggggccaaaattccaagatgggtcaaattttaatttcagtgtcagtacagctgtgcttataatgatgtctttgttagcagtaatggttttacaaatctgtttctgggctaaagcactttagtcccattaatgataaaacttcagttactctctgaattttcctttttttgagactgaatcctgttgccccaggaggttgaggatgcagtgagctgtgtcacaccactggattccagcctgggtgacagggtgagatgttgtctcaaataaaatattaaaaattggatcaccttattcagcattctgttgtttagcagttttggaattttagttgttagtaaatcttgaccttgagtacacgttattttgatattctgtgtgacaaaatgggaagtatgcatgaagcacatctgccataaagtatggatgtctagattttnttttccctagaaaaagtagttacaattgtttgagatacaagctgaactagctgcttgtttncacagaacatttttagtttgaaaaaacctgacaaattgattattcatattttaggggtaattttggcagagatttgctcaaaaaagaacaagtcagcttggaaaaaactgatggcatttgttgccaatgataaaactcaagcttccaaatgaaacctaaaattttggaaggcttgtatacacttctgtgccc

SEQ ID NO: 368713 - DNA, 1216 bp, Homo sapiens
  misc_feature (86)..(86): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctggtaagtattaatgaaaacagtagatagacttaatgaaaatgctgatggtgatatgcttactgctgagctaatggcttaaggcttggctgatgaatactgactgtattttccttgagcatgtctggaacagtgtttatgtgttttccttgagcatgtttggaacggggtttgtgtaatgatgttgatcaaatgtctgacctgaaatgagcatgtagacaaaggtaacactgaagaaccctgtgacagacaactttgaaaagagtttaatgatgtttagcattttaatggaagtcctcatttgtattccagctcctggtaacgtttttatccatggatgacttgcttgggtaaggacatgaagacagttcctgtcataccttttaaagtacatgttttattgatgttaacgttaattgattgagctactgttagtgatgattttaaaattaaagcagatgggaatctctctgagaaagaaaatggagattaatcttaaactgaaacagtagttgggaaatcttttagaaatccacctattactacctattggtaaaggagattaaatttctacaggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatcca

SEQ ID NO: 368714 - DNA, 2368 bp, Homo sapiens
  misc_feature (86)..(86): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaggggatttcagtctccacatagttttggagccggacttttgaagaatgattcgtgaatccggaatgggtgacagcgtcatcacggcattttattgacagaccatggattcttacagtgcaccagagtcaactcctagtgcatcctcaagacctgaagattactttataggtgccactcctctgcagaaacgattagaatcggtcaggaagcagagttcatttatcctgactccacctcgaaggaaaattccccagtgttcgcagttgcaggaatgaaaggaacacaaagggacccggaagcatttcttgtccagattgtgtcaaaatctcaattgccatctgagaatagagaaggtaaagtgctgtggactggctggttctgctgtgtatttggagacagtcttctggagactgtttcagaagatttcacctgtctgcccttattccttgcaaatggagcagagtctaacacagcaataattggaacttggtttcagaaaacctttgactgttatttcagtcctttagcaatcaatgcatttaatctttcctggatggctgccatgtggactgcatgcaaaatggaccattatgtggctactactgaatttctttggtctgtaccctgtagccctcaaagtctggacatttctttcgcaatacatccagaggatgcaaaagctctatgggacagtgtccacaaaacacctggggaggttacccaggaagaagttgacctattcatggattgcctttattcacatttccatagacatttcaaaattcatttatcagccacaagattagttcgtgtttcaacatctgtagcttcagcacatactgatggaaaaataaagattctgtgtcataaataccttattggagtgttagcatatttgacagaactggcaatttttcaaattgagtgaagccttatgtggactataagttatagattatatactcttattgataacttgcctaattgctatgctgaaagagactgcaggagaaataggcatctatctctgcatctgttttccccaccatgcctttggagttgccaagatggaagccaagaaggatctagaagaacaaagaatatggtagtagatgagccacagccaggtgcccatgtactaatcatgataacctgacatgccattctcaaaatgctgagttgttaatttcttgtcatctttaaatatatatatataggctgggcttggtggctcacacctgtaattccagcactttgggaggctgaggtgggtggatcatttgaggccaggaattcaagaccagcctggccaacatggtgaaaccccttctctactgaaaatacaataattagctgggcgtggtggcacatgcctatgatcccagctactggggaggctgaggcaggagaatcgttttaacccagaagacaggctgcagtgagccaagactgcaccactgcactccagcctgggcaacaaagtgagactctgcctcaaaaaataaaaaagaaataaaataaataaatacagcgtttattatgtttaaactcttaggattcaaatgagatgtatctaatggatatttctgatttgggtctttaaaacctttaatctcttttaagcattttagacttgcattcagaaagaattctgtcttctaaagacattttcctagcatttcactgcggagaactggcaatcaaaatcccctcaaaagggaactaaagattaatatacacatttttttagtcattaatatgcttctgttttaaatacagttcaactcctgttgcaatgttgaattaaatgtttattttaaaatg

SEQ ID NO: 368715 - DNA, 889 bp, Homo sapiens
  misc_feature (86)..(86): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgcaggttagtttaaactttgaaggaaatttttaaggtggcaaaaggttttggtggcatatacaccttaatctgtagatgggagtgattagctgtttaaaagttaaaatgtgactgagaaggaaattgagtagggcaaattttaaatgggtattatttttcatcttcaaacaggcagacctgttatcctaaactaagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatcca

SEQ ID NO: 368716 - DNA, 697 bp, Homo sapiens
  misc_feature (86)..(86): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgcagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatcca

SEQ ID NO: 368717 - DNA, 1715 bp, Homo sapiens
  misc_feature (86)..(86): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgcaggttagtttaaactttgaaggaaatttttaaggtggcaaaaggttttggtggcatatacaccttaatctgtagatgggagtgattagctgtttaaaagttaaaatgtgactgagaaggaaattgagtagggcaaattttaaatgggtattatttttcatcttcaaacaggcagacctgttatcctaaactaggtgagtcagcttttggtacatgtgatgattttcagtgtaaccaatgatgtaatgattctgccaaatgaaatataatgatatcactgtaaaaccgttccattttgattctgaggttactctactaacaagcatcacacatttgtattttgccctgattaatatgttggcttcgctttcagggtttttaatgaccacaacaagcaagcatgcagcttactgcttgaaaggtgaggattggaaatgttgggactattataattgcagaatacatgatgatctcaatccaacttgaactctctcactgattacttgatgacaataaaatatctgatattctgcattcccatgtagcattttaattgaagtctgtaaatgtggctaaaagtcttgtcttattttttgagacagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatccaaaaaaaaaaaaaaaaaaaaaaaaaaaaaaaaaaaaaaaaaaagaaaaagagagagaagagcagagagaagaagaaagaaagaagaagagcaaagagagagaacagagagaagagagcagagagagagagaggagaggagagaagagcggggagggcaaccaaaaaaaaagaaccacaaagagaaggaagcacaagaaaacaaaagacagggacacaaccacgagaagaacaaaaaaacaaagagccgcacatcacaagaagaaaaacacacgaagtagcaaagaggaagggacgaaggaaggagggacggagagataccaaaacacaaaaccccagaaaaggaaggaagaaaggaaaaaccagcaagaagagcgagggacactcacgtgagagaagcagggcaacctcagcaaagacaagagaagcaggagagaagaaacaaacaaccagcaaagaacgcgaaccaa

SEQ ID NO: 368718 - DNA, 2611 bp, Homo sapiens
  misc_feature (86)..(86): n is a, c, g, or t
  misc_feature (2358)..(2358): n is a, c, g, or t
  misc_feature (2419)..(2419): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaagtacatgttttattgatgttaacgttaattgattgagctactgttagtgatgattttaaaattaaagcagatgggaatctctctgagaaagaaaatggagattaatcttaaactgaaacagtagttgggaaatcttttagaaatccacctattactacctattggtaaaggagattaaatttctacaggtatggagagtcggcttgactacactgtgtggagcaagttttaaagaagcaaaggactcagaattcatgattgaagaaatgcaggttagtttaaactttgaaggaaatttttaaggtggcaaaaggttttggtggcatatacaccttaatctgtagatgggagtgattagctgtttaaaagttaaaatgtgactgagaaggaaattgagtagggcaaattttaaatgggtattatttttcatcttcaaacaggcagacctgttatcctaaactaggtgagtcagcttttggtacatgtgatgattttcagtgtaaccaatgatgtaatgattctgccaaatgaaatataatgatatcactgtaaaaccgttccattttgattctgaggttactctactaacaagcatcacacatttgtattttgccctgattaatatgttggcttcgctttcagggtttttaatgaccacaacaagcaagcatgcagcttactgcttgaaaggtgaggattggaaatgttgggactattataattgcagaatacatgatgatctcaatccaacttgaactctctcactgattacttgatgacaataaaatatctgatattctgcattcccatgtagcattttaattgaagtctgtaaatgtggctaaaagtcttgtcttattttttgagacagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatccatctggagtgtgtagtgtttacttaaaaaaggacagtgcttttcatctgttcattagctgtaagcataaatcacattcaaaagctattataactccatggtatttgcttcattaacactgcagccagttaaaattttatgggtattttacaaggtgtcttatgcattaaagtgcaatatttcctaattctccatatgagcaaattgtcaggtttcataggcccctgtgctaattggttttgagcttaaagtattgatggagctacttggagaaagtcatgttgagtctgaggctgggaaaataagttatagaaaatactatagaaatgcccaactagtgataggcattaatggaattgggaaaatctacaatccatagccatggtgataggtttttggcaagcactaagtgtttagggatgccaaaagtgggtataaagggcacaactggtttaaggcaatctgtcccagggaaacaggaccaaggggccaaaattccaagatgggtcaaattttaatttcagtgtcagtacagctgtgcttataatgatgtctttgttagcagtaatggttttacaaatctgtttctgggctaaagcactttagtcccattaatgataaaacttcagttactctctgaattttcctttttttgagactgaatcctgttgccccaggaggttgaggatgcagtgagctgtgtcacaccactggattccagcctgggtgacagggtgagatgttgtctcaaataaaatattaaaaattggatcaccttattcagcattctgttgtttagcagttttggaattttagttgttagtaaatcttgaccttgagtacacgttattttgatattctgtgtgacaaaatgggaagtatgcatgaagcacatctgccataaagtatggatgtctagattttnttttccctagaaaaagtagttacaattgtttgagatacaagctgaactagctgcttgtttncacagaacatttttagtttgaaaaaacctgacaaattgattattcatattttaggggtaattttggcagagatttgctcaaaaaagaacaagtcagcttggaaaaaactgatggcatttgttgccaatgataaaactcaagcttccaaatgaaacctaaaattttggaaggcttgtatacacttctgtgccc

SEQ ID NO: 368719 - DNA, 1413 bp, Homo sapiens
  misc_feature (86)..(86): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggtatagcagttccaagtattttttttttttttttagacaagagtctagctcttgcccagaatggagtgcagcggcactatcagttcactgcaacctctgcctcccaggttcaaggaattctcctgcctcagcctcttgagtagctgggattacaggcatgtgacaccatgcctggctaattttgtacagctatgttgtccaggctggtctcgaactcttgacctcaagtgatactgcccgcactgacctcccaaagtgctgggattacaggcgtgagccaccatgccccgcctcaagtctggtttttaagtgttgtaaagccgatacaatgatgataacatagttcagcagactaacgctgatgagcaatattaagtctttcgctcctatctgatgtatctggcggtaacattctagtttatgccccgaaaaggggaatatagccattctataatgtttggagattttggattactcctaattgtatgcaagttgtcttactgtgtattgtcccttaatttcaggactcagaattcatgattgaagaaatgcaggttagtttaaactttgaaggaaatttttaaggtggcaaaaggttttggtggcatatacaccttaatctgtagatgggagtgattagctgtttaaaagttaaaatgtgactgagaaggaaattgagtagggcaaattttaaatgggtattatttttcatcttcaaacaggcagacctgttatcctaaactaagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatcca

SEQ ID NO: 368720 - DNA, 900 bp, Homo sapiens
  misc_feature (86)..(86): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgcaggcagacctgttatcctaaacagggtttttaatgaccacaacaagcaagcatgcagcttactgcttgaaaggtgaggattggaaatgttgggactattataattgcagaatacatgatgatctcaatccaacttgaactctctcactgattacttgatgacaataaaatatctgatattctgcattcccatgtagcattttaattgaagtctgtaaatgtggctaaaagtcttgtcttattttttgagacagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatcca

SEQ ID NO: 368721 - DNA, 2422 bp, Homo sapiens
  misc_feature (86)..(86): n is a, c, g, or t
  misc_feature (2169)..(2169): n is a, c, g, or t
  misc_feature (2230)..(2230): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggtatagcagttccaagtattttttttttttttttagacaagagtctagctcttgcccagaatggagtgcagcggcactatcagttcactgcaacctctgcctcccaggttcaaggaattctcctgcctcagcctcttgagtagctgggattacaggcatgtgacaccatgcctggctaattttgtacagctatgttgtccaggctggtctcgaactcttgacctcaagtgatactgcccgcactgacctcccaaagtgctgggattacaggcgtgagccaccatgccccgcctcaagtctggtttttaagtgttgtaaagccgatacaatgatgataacatagttcagcagactaacgctgatgagcaatattaagtctttcgctcctatctgatgtatctggcggtaacattctagtttatgccccgaaaaggggaatatagccattctataatgtttggagattttggattactcctaattgtatgcaagttgtcttactgtgtattgtcccttaatttcaggactcagaattcatgattgaagaaatgccaggcagacctgttatcctaaactaagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatccatctggagtgtgtagtgtttacttaaaaaaggacagtgcttttcatctgttcattagctgtaagcataaatcacattcaaaagctattataactccatggtatttgcttcattaacactgcagccagttaaaattttatgggtattttacaaggtgtcttatgcattaaagtgcaatatttcctaattctccatatgagcaaattgtcaggtttcataggcccctgtgctaattggttttgagcttaaagtattgatggagctacttggagaaagtcatgttgagtctgaggctgggaaaataagttatagaaaatactatagaaatgcccaactagtgataggcattaatggaattgggaaaatctacaatccatagccatggtgataggtttttggcaagcactaagtgtttagggatgccaaaagtgggtataaagggcacaactggtttaaggcaatctgtcccagggaaacaggaccaaggggccaaaattccaagatgggtcaaattttaatttcagtgtcagtacagctgtgcttataatgatgtctttgttagcagtaatggttttacaaatctgtttctgggctaaagcactttagtcccattaatgataaaacttcagttactctctgaattttcctttttttgagactgaatcctgttgccccaggaggttgaggatgcagtgagctgtgtcacaccactggattccagcctgggtgacagggtgagatgttgtctcaaataaaatattaaaaattggatcaccttattcagcattctgttgtttagcagttttggaattttagttgttagtaaatcttgaccttgagtacacgttattttgatattctgtgtgacaaaatgggaagtatgcatgaagcacatctgccataaagtatggatgtctagattttnttttccctagaaaaagtagttacaattgtttgagatacaagctgaactagctgcttgtttncacagaacatttttagtttgaaaaaacctgacaaattgattattcatattttaggggtaattttggcagagatttgctcaaaaaagaacaagtcagcttggaaaaaactgatggcatttgttgccaatgataaaactcaagcttccaaatgaaacctaaaattttggaaggcttgtatacacttctgtgccc

SEQ ID NO: 368722 - DNA, 2133 bp, Homo sapiens
  misc_feature (86)..(86): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaggggatttcagtctccacatagttttggagccggacttttgaagaatgattcgtgaatccggaatgggtgacagcgtcatcacggcattttattggtaaagatgctttgtattggtcccggacctgctttaactttgtatttgccctgttgtgtggtcattatcttacaatacttgcgtgttgaggtgtgtttaaacactacgtgcttaacactggctaagtattggcattggggcggttggatttaggtattggtggcaatgtagaaaagtgatcaagtcagagccccttcacggactaatcacaagagaaacaacaaagctttacttgtgtgctgtgaaccacaactgcaagtggaattgtcaagagaactagccctgccaagctcaggaaaacttctgaggagatggcacatggaaaatggataagatttactgagacaaacgggagtagagaagtgtttttaattggcgataaggtgaataaaaaggcagggagaacagtagagtgatcatctgtctagagtagggggtgcatgtttgggtatagggctgtcatttaacctcttaaagaattgtctactggaactttcttcactcccatccccccaccccccaatgttgtatacaaaaccttagaggaagtgtatgcagaatgttggattttggaaaggctaatgtcgatggatcttggggaagaactgaagtagtagaaaatgaacctggataggatcagataataagatcaaatacagtagtgccttgaaagccagacaggaattctgatttgacttcatatagatgtgtgggaactgttatgggatctcaagcaaggtaatgataaaagtggtgacaatgaaagactgatgatggattagggaaaggggctaagattgggaacaagataagtagctataattgagaatgaaagtgaagcccacatctaagaggacaagtgtatatctttttaagaaatatgtcagaggccaggttggtggctcacacctgtaattccagcactttgggaggctgaggtgggtggatcatttgaggccaggaattcaagaccagcctggccaacatggtgaaaccccttctctactgaaaatacaataattagctgggcgtggtggcacatgcctatgatcccagctactggggaggctgaggcaggagaatcgttttaacccagaagacaggctgcagtgagccaagactgcaccactgcactccagcctgggcaacaaagtgagactctgcctcaaaaaataaaaaagaaataaaataaataaatacagcgtttattatgtttaaactcttaggattcaaatgagatgtatctaatggatatttctgatttgggtctttaaaacctttaatctcttttaagcattttagacttgcattcagaaagaattctgtcttctaaagacattttcctagcatttcactgcggagaactggcaatcaaaatcccctcaaaagggaactaaagattaatatacacatttttttagtcattaatatgcttctgttttaaatacagttcaactcctgttgcaatgttgaattaaatgtttattttaaaatg

SEQ ID NO: 368723 - DNA, 1834 bp, Homo sapiens
  misc_feature (86)..(86): n is a, c, g, or t
  misc_feature (1581)..(1581): n is a, c, g, or t
  misc_feature (1642)..(1642): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaaggactcagaattcatgattgaagaaatgcagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatccatctggagtgtgtagtgtttacttaaaaaaggacagtgcttttcatctgttcattagctgtaagcataaatcacattcaaaagctattataactccatggtatttgcttcattaacactgcagccagttaaaattttatgggtattttacaaggtgtcttatgcattaaagtgcaatatttcctaattctccatatgagcaaattgtcaggtttcataggcccctgtgctaattggttttgagcttaaagtattgatggagctacttggagaaagtcatgttgagtctgaggctgggaaaataagttatagaaaatactatagaaatgcccaactagtgataggcattaatggaattgggaaaatctacaatccatagccatggtgataggtttttggcaagcactaagtgtttagggatgccaaaagtgggtataaagggcacaactggtttaaggcaatctgtcccagggaaacaggaccaaggggccaaaattccaagatgggtcaaattttaatttcagtgtcagtacagctgtgcttataatgatgtctttgttagcagtaatggttttacaaatctgtttctgggctaaagcactttagtcccattaatgataaaacttcagttactctctgaattttcctttttttgagactgaatcctgttgccccaggaggttgaggatgcagtgagctgtgtcacaccactggattccagcctgggtgacagggtgagatgttgtctcaaataaaatattaaaaattggatcaccttattcagcattctgttgtttagcagttttggaattttagttgttagtaaatcttgaccttgagtacacgttattttgatattctgtgtgacaaaatgggaagtatgcatgaagcacatctgccataaagtatggatgtctagattttnttttccctagaaaaagtagttacaattgtttgagatacaagctgaactagctgcttgtttncacagaacatttttagtttgaaaaaacctgacaaattgattattcatattttaggggtaattttggcagagatttgctcaaaaaagaacaagtcagcttggaaaaaactgatggcatttgttgccaatgataaaactcaagcttccaaatgaaacctaaaattttggaaggcttgtatacacttctgtgccc

SEQ ID NO: 368724 - DNA, 722 bp, Homo sapiens
  misc_feature (86)..(86): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgccaggcagacctgttatcctaaactaagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatcca

SEQ ID NO: 368725 - DNA, 2945 bp, Homo sapiens
  misc_feature (86)..(86): n is a, c, g, or t
  misc_feature (1102)..(1102): n is a, c, g, or t
  misc_feature (1604)..(1604): n is a, c, g, or t
  misc_feature (1721)..(1721): n is a, c, g, or t
  misc_feature (1764)..(1764): n is a, c, g, or t
  misc_feature (1817)..(1818): n is a, c, g, or t
  misc_feature (1824)..(1824): n is a, c, g, or t
  misc_feature (1907)..(1907): n is a, c, g, or t
  misc_feature (2396)..(2396): n is a, c, g, or t
  misc_feature (2692)..(2692): n is a, c, g, or t
  misc_feature (2753)..(2753): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctggtaagtattaatgaaaacagtagatagacttaatgaaaatgctgatggtgatatgcttactgctgagctaatggcttaaggcttggctgatgaatactgactgtattttccttgagcatgtctggaacagtgtttatgtgttttccttgagcatgtttggaacggggtttgtgtaatgatgttgatcaaatgtctgacctgaaatgagcatgtagacaaaggtaacactgaagaaccctgtgacagacaactttgaaaagagtttaatgatgtttagcattttaatggaagtcctcatttgtattccagctcctggtaacgtttttatccatggatgacttgcttgggtaaggacatgaagacagttcctgtcataccttttaaagtacatgttttattgatgttaacgttaattgattgagctactgttagtgatgattttaaaattaaagcagatgggaatctctctgagaaagaaaatggagattaatcttaaactgaaacagtagttgggaaatcttttagaaatccacctattactacctattggtaaaggagattaaatttctacaggtatggagagtcggcttgactacactgtgtggagcaagttttaaagaagcaaaggtatagcagttccaagtattttttttttttttttagacaagagtctagctcttgcccagaatggagtgcagcggcactatcagttcactgcaacctctgcctcccaggttcaaggaattctcctgcctcagcctcttgagtagctgaggcaggagaattgcntgaacctaggaagtggaggttgcagtgaactgagatcatgccaccgcactccagcctgggcaacggcgagacttggtctcaaaaaaaaacacacacacaaaactaccaccacctaccccaatcggttaccctttacttttcatgtgaccaccatgacctattatgtgttttgttcttacttcccccacaagaatgtaagcgcttcaagtttattccttaatgttggaaaaatgaatgaaactgcaaatgtagtagatcagtttttggggaggtaccaaagacaagttggtaaaataccttgattttgaagtgaaaaacgatgttacatttcaaagtatcttttcgccaggttatggctcaggcttcgagaccagcctggccaacatggcaaaacccggtctctactgaaaaaaagcgaaaattagccgggtgtggtagtgtgggcctgtagtcccagctactctgaaccctggaggtggaggttgcagtgaaccaagatcgngccacctcactccagcctgggcctcctaggctcaagtgattgttgtgcctcaactacctgagtagctgggatgacaggtgtgtgccaccactcccagctaatttttttttctgtatntttagtagagatggagtttcaccatgtcagccaggctagtctngaactcctggcctcaagtgatccaactgccctgccctcccaaagtgctgggannacaggngtgagccactgcatccagccaagttctattcttttttttttttttgagacggagtttcgctcgtgttgcccaggctggaatgnagcggcgcaatcttggctcactgcaacctccacctcccaggttcaagcgattctcctgcctcagccttccaagtagctgggattacaggcgtgggccaccatgcctggctatttttgtatttttagtagagagggggtttcaccacgttggccaggctggtctcgaactcctgacctcgtgatctgcccacctagcctcccaaagtgctgggattacaggcgtgagccaccgcatccagcttcttgttctctcttttatatataagtgccatttgctgaatcagaaaactttttgacaagcatattaaaagatttcagttgtatgtagtagctcatgcctgtaatcccaacactttgggaaaccaaggtggggggattgcttgagtccaggagttcaagaccggcctgggcaacatagtgagaccctgtgtctacaattaaaaaaaaaaagaaaaaaaaagtgagccgggcatgatggtgcatgcctgnagtcccaaccactcatgagactgaggtgggacgatcgcttgagcccaggaggttgaggatgcagtgagctgtgtcacaccactggattccagcctgggtgacagggtgagatgttgtctcaaataaaatattaaaaattggatcaccttattcagcattctgttgtttagcagttttggaattttagttgttagtaaatcttgaccttgagtacacgttattttgatattctgtgtgacaaaatgggaagtatgcatgaagcacatctgccataaagtatggatgtctagattttnttttccctagaaaaagtagttacaattgtttgagatacaagctgaactagctgcttgtttncacagaacatttttagtttgaaaaaacctgacaaattgattattcatattttaggggtaattttggcagagatttgctcaaaaaagaacaagtcagcttggaaaaaactgatggcatttgttgccaatgataaaactcaagcttccaaatgaaacctaaaattttggaaggcttgtatacacttctgtgccc

SEQ ID NO: 368726 - DNA, 658 bp, Homo sapiens
  misc_feature (86)..(86): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaaggactcagaattcatgattgaagaaatgcagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatcca

SEQ ID NO: 368727 - DNA, 2037 bp, Homo sapiens
  misc_feature (86)..(86): n is a, c, g, or t
  misc_feature (1784)..(1784): n is a, c, g, or t
  misc_feature (1845)..(1845): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaaggactcagaattcatgattgaagaaatgcaggcagacctgttatcctaaacagggtttttaatgaccacaacaagcaagcatgcagcttactgcttgaaaggtgaggattggaaatgttgggactattataattgcagaatacatgatgatctcaatccaacttgaactctctcactgattacttgatgacaataaaatatctgatattctgcattcccatgtagcattttaattgaagtctgtaaatgtggctaaaagtcttgtcttattttttgagacagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatccatctggagtgtgtagtgtttacttaaaaaaggacagtgcttttcatctgttcattagctgtaagcataaatcacattcaaaagctattataactccatggtatttgcttcattaacactgcagccagttaaaattttatgggtattttacaaggtgtcttatgcattaaagtgcaatatttcctaattctccatatgagcaaattgtcaggtttcataggcccctgtgctaattggttttgagcttaaagtattgatggagctacttggagaaagtcatgttgagtctgaggctgggaaaataagttatagaaaatactatagaaatgcccaactagtgataggcattaatggaattgggaaaatctacaatccatagccatggtgataggtttttggcaagcactaagtgtttagggatgccaaaagtgggtataaagggcacaactggtttaaggcaatctgtcccagggaaacaggaccaaggggccaaaattccaagatgggtcaaattttaatttcagtgtcagtacagctgtgcttataatgatgtctttgttagcagtaatggttttacaaatctgtttctgggctaaagcactttagtcccattaatgataaaacttcagttactctctgaattttcctttttttgagactgaatcctgttgccccaggaggttgaggatgcagtgagctgtgtcacaccactggattccagcctgggtgacagggtgagatgttgtctcaaataaaatattaaaaattggatcaccttattcagcattctgttgtttagcagttttggaattttagttgttagtaaatcttgaccttgagtacacgttattttgatattctgtgtgacaaaatgggaagtatgcatgaagcacatctgccataaagtatggatgtctagattttnttttccctagaaaaagtagttacaattgtttgagatacaagctgaactagctgcttgtttncacagaacatttttagtttgaaaaaacctgacaaattgattattcatattttaggggtaattttggcagagatttgctcaaaaaagaacaagtcagcttggaaaaaactgatggcatttgttgccaatgataaaactcaagcttccaaatgaaacctaaaattttggaaggcttgtatacacttctgtgccc

SEQ ID NO: 368728 - DNA, 2015 bp, Homo sapiens
  misc_feature (86)..(86): n is a, c, g, or t
  misc_feature (1762)..(1762): n is a, c, g, or t
  misc_feature (1823)..(1823): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaaggactcagaattcatgattgaagaaatgcagggtttttaatgaccacaacaagcaagcatgcagcttactgcttgaaaggtgaggattggaaatgttgggactattataattgcagaatacatgatgatctcaatccaacttgaactctctcactgattacttgatgacaataaaatatctgatattctgcattcccatgtagcattttaattgaagtctgtaaatgtggctaaaagtcttgtcttattttttgagacagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatccatctggagtgtgtagtgtttacttaaaaaaggacagtgcttttcatctgttcattagctgtaagcataaatcacattcaaaagctattataactccatggtatttgcttcattaacactgcagccagttaaaattttatgggtattttacaaggtgtcttatgcattaaagtgcaatatttcctaattctccatatgagcaaattgtcaggtttcataggcccctgtgctaattggttttgagcttaaagtattgatggagctacttggagaaagtcatgttgagtctgaggctgggaaaataagttatagaaaatactatagaaatgcccaactagtgataggcattaatggaattgggaaaatctacaatccatagccatggtgataggtttttggcaagcactaagtgtttagggatgccaaaagtgggtataaagggcacaactggtttaaggcaatctgtcccagggaaacaggaccaaggggccaaaattccaagatgggtcaaattttaatttcagtgtcagtacagctgtgcttataatgatgtctttgttagcagtaatggttttacaaatctgtttctgggctaaagcactttagtcccattaatgataaaacttcagttactctctgaattttcctttttttgagactgaatcctgttgccccaggaggttgaggatgcagtgagctgtgtcacaccactggattccagcctgggtgacagggtgagatgttgtctcaaataaaatattaaaaattggatcaccttattcagcattctgttgtttagcagttttggaattttagttgttagtaaatcttgaccttgagtacacgttattttgatattctgtgtgacaaaatgggaagtatgcatgaagcacatctgccataaagtatggatgtctagattttnttttccctagaaaaagtagttacaattgtttgagatacaagctgaactagctgcttgtttncacagaacatttttagtttgaaaaaacctgacaaattgattattcatattttaggggtaattttggcagagatttgctcaaaaaagaacaagtcagcttggaaaaaactgatggcatttgttgccaatgataaaactcaagcttccaaatgaaacctaaaattttggaaggcttgtatacacttctgtgccc

SEQ ID NO: 368729 - DNA, 2165 bp, Homo sapiens
  misc_feature (86)..(86): n is a, c, g, or t
  misc_feature (1912)..(1912): n is a, c, g, or t
  misc_feature (1973)..(1973): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgaggactcagaattcatgattgaagaaatgccaggcagacctgttatcctaaactaggtgagtcagcttttggtacatgtgatgattttcagtgtaaccaatgatgtaatgattctgccaaatgaaatataatgatatcactgtaaaaccgttccattttgattctgaggttactctactaacaagcatcacacatttgtattttgccctgattaatatgttggcttcgctttcagggtttttaatgaccacaacaagcaagcatgcagcttactgcttgaaaggtgaggattggaaatgttgggactattataattgcagaatacatgatgatctcaatccaacttgaactctctcactgattacttgatgacaataaaatatctgatattctgcattcccatgtagcattttaattgaagtctgtaaatgtggctaaaagtcttgtcttattttttgagacagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatccatctggagtgtgtagtgtttacttaaaaaaggacagtgcttttcatctgttcattagctgtaagcataaatcacattcaaaagctattataactccatggtatttgcttcattaacactgcagccagttaaaattttatgggtattttacaaggtgtcttatgcattaaagtgcaatatttcctaattctccatatgagcaaattgtcaggtttcataggcccctgtgctaattggttttgagcttaaagtattgatggagctacttggagaaagtcatgttgagtctgaggctgggaaaataagttatagaaaatactatagaaatgcccaactagtgataggcattaatggaattgggaaaatctacaatccatagccatggtgataggtttttggcaagcactaagtgtttagggatgccaaaagtgggtataaagggcacaactggtttaaggcaatctgtcccagggaaacaggaccaaggggccaaaattccaagatgggtcaaattttaatttcagtgtcagtacagctgtgcttataatgatgtctttgttagcagtaatggttttacaaatctgtttctgggctaaagcactttagtcccattaatgataaaacttcagttactctctgaattttcctttttttgagactgaatcctgttgccccaggaggttgaggatgcagtgagctgtgtcacaccactggattccagcctgggtgacagggtgagatgttgtctcaaataaaatattaaaaattggatcaccttattcagcattctgttgtttagcagttttggaattttagttgttagtaaatcttgaccttgagtacacgttattttgatattctgtgtgacaaaatgggaagtatgcatgaagcacatctgccataaagtatggatgtctagattttnttttccctagaaaaagtagttacaattgtttgagatacaagctgaactagctgcttgtttncacagaacatttttagtttgaaaaaacctgacaaattgattattcatattttaggggtaattttggcagagatttgctcaaaaaagaacaagtcagcttggaaaaaactgatggcatttgttgccaatgataaaactcaagcttccaaatgaaacctaaaattttggaaggcttgtatacacttctgtgccc

SEQ ID NO: 368730 - DNA, 1806 bp, Homo sapiens
  misc_feature (86)..(86): n is a, c, g, or t
  misc_feature (1553)..(1553): n is a, c, g, or t
  misc_feature (1614)..(1614): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgaggactcagaattcatgattgaagaaatgccaggcagacctgttatcctaaactaagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatccatctggagtgtgtagtgtttacttaaaaaaggacagtgcttttcatctgttcattagctgtaagcataaatcacattcaaaagctattataactccatggtatttgcttcattaacactgcagccagttaaaattttatgggtattttacaaggtgtcttatgcattaaagtgcaatatttcctaattctccatatgagcaaattgtcaggtttcataggcccctgtgctaattggttttgagcttaaagtattgatggagctacttggagaaagtcatgttgagtctgaggctgggaaaataagttatagaaaatactatagaaatgcccaactagtgataggcattaatggaattgggaaaatctacaatccatagccatggtgataggtttttggcaagcactaagtgtttagggatgccaaaagtgggtataaagggcacaactggtttaaggcaatctgtcccagggaaacaggaccaaggggccaaaattccaagatgggtcaaattttaatttcagtgtcagtacagctgtgcttataatgatgtctttgttagcagtaatggttttacaaatctgtttctgggctaaagcactttagtcccattaatgataaaacttcagttactctctgaattttcctttttttgagactgaatcctgttgccccaggaggttgaggatgcagtgagctgtgtcacaccactggattccagcctgggtgacagggtgagatgttgtctcaaataaaatattaaaaattggatcaccttattcagcattctgttgtttagcagttttggaattttagttgttagtaaatcttgaccttgagtacacgttattttgatattctgtgtgacaaaatgggaagtatgcatgaagcacatctgccataaagtatggatgtctagattttnttttccctagaaaaagtagttacaattgtttgagatacaagctgaactagctgcttgtttncacagaacatttttagtttgaaaaaacctgacaaattgattattcatattttaggggtaattttggcagagatttgctcaaaaaagaacaagtcagcttggaaaaaactgatggcatttgttgccaatgataaaactcaagcttccaaatgaaacctaaaattttggaaggcttgtatacacttctgtgccc

SEQ ID NO: 368731 - DNA, 1246 bp, Homo sapiens
  misc_feature (86)..(86): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggtatagcagttccaagtattttttttttttttttagacaagagtctagctcttgcccagaatggagtgcagcggcactatcagttcactgcaacctctgcctcccaggttcaaggaattctcctgcctcagcctcttgagtagctgggattacaggcatgtgacaccatgcctggctaattttgtacagctatgttgtccaggctggtctcgaactcttgacctcaagtgatactgcccgcactgacctcccaaagtgctgggattacaggcgtgagccaccatgccccgcctcaagtctggtttttaagtgttgtaaagccgatacaatgatgataacatagttcagcagactaacgctgatgagcaatattaagtctttcgctcctatctgatgtatctggcggtaacattctagtttatgccccgaaaaggggaatatagccattctataatgtttggagattttggattactcctaattgtatgcaagttgtcttactgtgtattgtcccttaatttcaggactcagaattcatgattgaagaaatgccaggcagacctgttatcctaaactaagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatcca

SEQ ID NO: 368732 - DNA, 2514 bp, Homo sapiens
  misc_feature (86)..(86): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaaggactcagaattcatgattgaagaaatgcagggtttttaatgaccacaacaagcaagcatgcagcttactgcttgaaggggatttcagtctccacatagttttggagccggacttttgaagaatgattcgtgaatccggaatgggtgacagcgtcatcacggcattttattgacagaccatggattcttacagtgcaccagagtcaactcctagtgcatcctcaagacctgaagattactttataggtgccactcctctgcagaaacgattagaatcggtcaggaagcagagttcatttatcctgactccacctcgaaggaaaattccccagtgttcgcagttgcaggaagatgttgaccctcaaaaggttgcattccttctgcataaacagtggactttatatagtttaactcccttatataaattctcctatagtaatctcaaagagtattctagacttctcaatgcttttattgttgctgaaaagcaaaaaggacttgctgtggaagtgggagaagacttcaacatcaaagtgattttttctactctcctaggaatgaaaggaacacaaagggacccggaagcatttcttgtccagattgtgtcaaaatctcaattgccatctgagaatagagaaggtaaagtgctgtggactggctggttctgctgtgtatttggagacagtcttctggagactgtttcagaagatttcacctgtctgcccttattccttgcaaatggagcagagtctaacacagcaataattggaacttggtttcagaaaacctttgactgttatttcagtcctttagcaatcaatgcatttaatctttcctggatggctgccatgtggactgcatgcaaaatggaccattatgtggctactactgaatttctttggtctgtaccctgtagccctcaaagtctggacatttctttcgcaatacatccagaggatgcaaaagctctatgggacagtgtccacaaaacacctggggaggttacccaggaagaagttgacctattcatggattgcctttattcacatttccatagacatttcaaaattcatttatcagccacaagattagttcgtgtttcaacatctgtagcttcagcacatactgatggaaaaataaagattctgtgtcataaataccttattggagtgttagcatatttgacagaactggcaatttttcaaattgagtgaagccttatgtggactataagttatagattatatactcttattgataacttgcctaattgctatgctgaaagagactgcaggagaaataggcatctatctctgcatctgttttccccaccatgcctttggagttgccaagatggaagccaagaaggatctagaagaacaaagaatatggtagtagatgagccacagccaggtgcccatgtactaatcatgataacctgacatgccattctcaaaatgctgagttgttaatttcttgtcatctttaaatatatatatataggctgggcttggtggctcacacctgtaattccagcactttgggaggctgaggtgggtggatcatttgaggccaggaattcaagaccagcctggccaacatggtgaaaccccttctctactgaaaatacaataattagctgggcgtggtggcacatgcctatgatcccagctactggggaggctgaggcaggagaatcgttttaacccagaagacaggctgcagtgagccaagactgcaccactgcactccagcctgggcaacaaagtgagactctgcctcaaaaaataaaaaagaaataaaataaataaatacagcgtttattatgtttaaactcttaggattcaaatgagatgtatctaatggatatttctgatttgggtctttaaaacctttaatctcttttaagcattttagacttgcattcagaaagaattctgtcttctaaagacattttcctagcatttcactgcggagaactggcaatcaaaatcccctcaaaagggaactaaagattaatatacacatttttttagtcattaatatgcttctgttttaaatacagttcaactcctgttgcaatgttgaattaaatgtttattttaaaatg

SEQ ID NO: 368733 - DNA, 909 bp, Homo sapiens
  misc_feature (86)..(86): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaagtacatgttttattgatgttaacgttaattgattgagctactgttagtgatgattttaaaattaaagcagatgggaatctctctgagaaagaaaatggagattaatcttaaactgaaacagtagttgggaaatcttttagaaatccacctattactacctattggtaaaggagattaaatttctacaggtatggagagtcggcttgactacactgtgtggagcaagttttaaagaagcaaaggactcagaattcatgattgaagaaatgccaggcagacctgttatcctaaactaagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatcca

SEQ ID NO: 368734 - DNA, 630 bp, Homo sapiens
  misc_feature (86)..(86): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgaggactcagaattcatgattgaagaaatgccaggcagacctgttatcctaaactaagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatcca

SEQ ID NO: 368735 - DNA, 1262 bp, Homo sapiens
  misc_feature (86)..(86): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaagtacatgttttattgatgttaacgttaattgattgagctactgttagtgatgattttaaaattaaagcagatgggaatctctctgagaaagaaaatggagattaatcttaaactgaaacagtagttgggaaatcttttagaaatccacctattactacctattggtaaaggagattaaatttctacaggtatggagagtcggcttgactacactgtgtggagcaagttttaaagaagcaaaggactcagaattcatgattgaagaaatgccaggcagacctgttatcctaaactaagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatccaaaaaaaaaaaaaaaaaaaaaaaaaaaaaaaaaaaaaaaaaaatttggggggggccgggcccgaaaaatttttaaacccctcggtggggggcggcgcgccagtaggttatgtgagacattgggcctaaacgctggtacccaggaacaccccggggtcagacacatgggtgggttcgcccccaaaaaaaagcccggggacaccggcggtttcggaccaatccagtgggttccgcgctcgccgcttctacacgggtccaggcgagccgatctagccccccgcggcagcgaaacagaagaagcaagaaggaaagcaggagaaggataaaaaaagagagaaaaacagcaggacagcag

SEQ ID NO: 368736 - DNA, 677 bp, Homo sapiens
  misc_feature (86)..(86): n is a, c, g, or t
cctggctgccaggtctggagagtcggcttgactacactgtgtggagcaagttttaaagaagcaaaggcagacctgagcatgacggntttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggtatagcagttccaagtattttttttttttttttagacaagagtctagctcttgcccagaatggagtgcagcggcactatcagttcactgcaacctctgcctcccaggtcctcaaacttctgggctcaagtgatcctcagcctcccagtggtctttgtagactgcctgatggagtctcatggcacaagaagattaaaacagtgtctccaattttaataaatttttgcaatcca

SEQ ID NO: 368737 - DNA, 802 bp, Homo sapiens
aactgaagaggcggcggagggccgaattcccttttctcaacggcttgatttcagagctgggctggtctctgacaggctcagctggagagggacgggttgggacgcactgtccttttgcccttccccctccgcgagcagaagctgactccgcaggagcgagggtcgcagagctgggtgagcggaaatgtccctcccagagtgaagtcgcagggcccgccccgcgtctgagggagcggaggtcttcctgggggatttcagtctccacatagttttggagccggacttttgaagaatgattcgtgaatccggaatgggtgacagcgtcatcacggcattttattgacagaccatggattcttacagtgcaccagagtcaactcctagtgcatcctcaagacctgaagattactttataggtgccactcctctgcagaaacgattagaatcggtcaggaagcagagttcatttatcctgactccacctcgaaggaaaattccccagtgttcgcagttgcaggaagatgttgaccctcaaaaggttgcattccttctgcataaacagtggactttatatagtttaactcccttatataaattctcctatagtaatctcaaagagtattctagacttctcaatgcttttattgttgctgaaaagcaaaaaggacttgctgtggaagtgggagaagacttcaacatcaaagtgattttttctactctcctaggaatgaaaggaacacaaagggacccggaagcatttcttgtcccagggtctcattttgtcacccaggctggagtacag

SEQ ID NO: 368738 - DNA, 396 bp, Homo sapiens
tccaacaaaataagctctcagctgggtgtggtggcatgtgcctgtagtcccaggtacttgcgaggatgaagcaggaggatcgcttgagcccaggagttcgagtaggcagagctatgatcgcaccacatccagcccggatgacaaagcgagactccatctttaaaggaaaaaataaaaaaaaaaacctaagcttttaaaattagtcatctaatgaaccactgaatacgataattatgtcttacatatttacaatatacactctctgacttaacgatggtctgacttgggatttttaaatttaagatggcataaaggcacatgcattcagtagaaaccgtactgcaagtacccacacaacaattttagttttcactgttagtgttcaataacttacat

SEQ ID NO: 368739 - DNA, 810 bp, Homo sapiens
gggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacaggtaaatttgagattgcaaatctgactctccagtgttccaggcaatgttctgttgatctggatggaggcaacagagtacctgggttttcttgggaattctccaagcttctcattaattacagagagtggatgaaaaagggtttagaaatcatctgtggattggaaagaagtaccttcaattgccattttttgtccctattcacctatcattagtaatatttattagactagaatatattgaaaaacac

SEQ ID NO: 368740 - DNA, 291 bp, Homo sapiens
ttatttagaatgacagcacaggtaattttaatgtaataataagtgcacgtttttatttacagctattggttttccttttcttcttctccttgatgggcctgctgtcgtcacatctgacctcaaatgtaagtcagaccttaccagccaaggtgtcctctcccactgtgggccaggcaggggcaccaggcagccagcttccaagtcagggtttccagactagctcaggagctccttgtgtttgcggaagtgtgagtgagaactcccaggccgtgggttttttttttttttttt

SEQ ID NO: 368741 - DNA, 5881 bp, Homo sapiens
gggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcgcggttgatgtactgcagagaatgctgatttttgcacttgacgctttggctgctggagtacaggaggagtcctccactcacaagatcgtgaggtgctggttcggagtgttcagtggacacacgcttggcagtgtaatttccacagatcctctgaagaggttcttcagtcataccctgactcagatactcactcacagccctgtgctgaaagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggcattcgagagctgccagctggacagcatggtcactgcgttcctggttgtgcgccaggcagcactggagggcccctctgcgttcctgtcatatgcagactggttcaaggcctcctttgggagcacacgaggctaccatggctgcagcaagaaggccctggtcttcctgtttacgttcttgtcagaactcgtgccttttgagtctccccggtacctgcaggtgcacattctccacccacccctggttcccagcaagtaccgctccctcctcacagactacatctcattggccaagacacggctggccgacctcaaggtttctatagaaaacatgggactctacgaggatttgtcatcagctggggacattactgagccccacagccaagctcttcaggatgttgaaaaggccatcatggtgtttgagcatacggggaacatcccagtcaccgtcatggaggccagcatattcaggaggccttactacgtgtcccacttcctccccgccctgctcacacctcgagtgctccccaaagtccctgactcccgtgtggcgtttatagagtctctgaagagagcagataaaatccccccatctctgtactccacctactgccaggcctgctctgctgctgaagagaagccagaagatgcagccctgggagtgagggcagaacccaactctgctgaggagcccctgggacagctcacagctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacatggctgtggacctcctgctgacgtctttctgtcagaacctgatggctgcctccagtgtcgctcccccggagaggcagggtccctgggctgccctcttcgtgaggaccatgtgtggacgtgtgctccctgcagtgctcacccggctctgccagctgctccgtcaccagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaaattttgtacagcagcaatttcttactctctctgcaagttttcttcccagtcacgagatactttgtgcagctgcttatctccaggccttattaaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaagctcaaggagttatgaccactcagaaaattctgatttggtctttggtggccgcacaggaaatgaggatattatttccagattgcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtgacctcaggctggggcggctcctcctccgtgtggccccggatcagcacaccaggctgctgcctttcgctttttacagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcagggcaaccccgtggaactgataacaaaagctcgtctttttctgctgcagttaatacctcggtgcccgaaaaagagcttctcacacgtggcagagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgagggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttccttaaccacagattcttgtcttttttttttttgagatggagtttcgctctgttacccaggctgcagtgcggtggcgtgatctcagctcactgcaacctgcgcctcccgggctcaagcgattcttgtgcctcagcctgccaagtagctgggattacaggcgccccccaccacgcccagctgatttttgtatttttagtagagacagggtttacaccatattggccaggctggtcttgaattcctgaccttgtgatctgcctgcctcggtctcccaaagtgctgggattacatgtgtgagccactgcatccggcctgtgggcttatcttttaatgtcttatttgaggacgtggtgcagcagccttggtgtgggtgctcgaagtccctggcctcctacctgagcctcttctgtccagaggcccagtat

SEQ ID NO: 368742 - DNA, 5796 bp, Homo sapiens
gggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcgcggttgatgtactgcagagaatgctgatttttgcacttgacgctttggctgctggagtacaggaggagtcctccactcacaagatcgtgaggtgctggttcggagtgttcagtggacacacgcttggcagtgtaatttccacagatcctctgaagaggttcttcagtcataccctgactcagatactcactcacagccctgtgctgaaagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggcattcgagagctgccagctggacagcatggtcactgcgttcctggttgtgcgccaggcagcactggagggcccctctgcgttcctgtcatatgcagactggttcaaggcctcctttgggagcacacgaggctaccatggctgcagcaagaaggccctggtcttcctgtttacgttcttgtcagaactcgtgccttttgagtctccccggtacctgcaggtgcacattctccacccacccctggttcccagcaagtaccgctccctcctcacagactacatctcattggccaagacacggctggccgacctcaaggtttctatagaaaacatgggactctacgaggatttgtcatcagctggggacattactgagccccacagccaagctcttcaggatgttgaaaaggccatcatggtgtttgagcatacggggaacatcccagtcaccgtcatggaggccagcatattcaggaggccttactacgtgtcccacttcctccccgccctgctcacacctcgagtgctccccaaagtccctgactcccgtgtggcgtttatagagtctctgaagagagcagataaaatccccccatctctgtactccacctactgccaggcctgctctgctgctgaagagaagccagaagatgcagccctgggagtgagggcagaacccaactctgctgaggagcccctgggacagctcacagctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacatggctgtggacctcctgctgacgtctttctgtcagaacctgatggctgcctccagtgtcgctcccccggagaggcagggtccctgggctgccctcttcgtgaggaccatgtgtggacgtgtgctccctgcagtgctcacccggctctgccagctgctccgtcaccagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaaattttgtacagcagcaatttcttactctctctgcaagttttcttcccagtcacgagatactttgtgcagctgcttatctccaggccttattaaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtgacctcaggctggggcggctcctcctccgtgtggccccggatcagcacaccaggctgctgcctttcgctttttacagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcagggcaaccccgtggaactgataacaaaagctcgtctttttctgctgcagttaatacctcggtgcccgaaaaagagcttctcacacgtggcagagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgagggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttccttaaccacagattcttgtcttttttttttttgagatggagtttcgctctgttacccaggctgcagtgcggtggcgtgatctcagctcactgcaacctgcgcctcccgggctcaagcgattcttgtgcctcagcctgccaagtagctgggattacaggcgccccccaccacgcccagctgatttttgtatttttagtagagacagggtttacaccatattggccaggctggtcttgaattcctgaccttgtgatctgcctgcctcggtctcccaaagtgctgggattacatgtgtgagccactgcatccggcctgtgggcttatcttttaatgtcttatttgaggacgtggtgcagcagccttggtgtgggtgctcgaagtccctggcctcctacctgagcctcttctgtccagaggcccagtat

SEQ ID NO: 368743 - DNA, 5708 bp, Homo sapiens
gggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcgcggttgatgtactgcagagaatgctgatttttgcacttgacgctttggctgctggagtacaggaggagtcctccactcacaagatcgtgaggtgctggttcggagtgttcagtggacacacgcttggcagtgtaatttccacagatcctctgaagaggttcttcagtcataccctgactcagatactcactcacagccctgtgctgaaagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggcattcgagagctgccagctggacagcatggtcactgcgttcctggttgtgcgccaggcagcactggagggcccctctgcgttcctgtcatatgcagactggttcaaggcctcctttgggagcacacgaggctaccatggctgcagcaagaaggccctggtcttcctgtttacgttcttgtcagaactcgtgccttttgagtctccccggtacctgcaggtgcacattctccacccacccctggttcccagcaagtaccgctccctcctcacagactacatctcattggccaagacacggctggccgacctcaaggtttctatagaaaacatgggactctacgaggatttgtcatcagctggggacattactgagccccacagccaagctcttcaggatgttgaaaaggccatcatggtgtttgagcatacggggaacatcccagtcaccgtcatggaggccagcatattcaggaggccttactacgtgtcccacttcctccccgccctgctcacacctcgagtgctccccaaagtccctgactcccgtgtggcgtttatagagtctctgaagagagcagataaaatccccccatctctgtactccacctactgccaggcctgctctgctgctgaagagaagccagaagatgcagccctgggagtgagggcagaacccaactctgctgaggagcccctgggacagctcacagctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacatggctgtggacctcctgctgacgtctttctgtcagaacctgatggctgcctccagtgtcgctcccccggagaggcagggtccctgggctgccctcttcgtgaggaccatgtgtggacgtgtgctccctgcagtgctcacccggctctgccagctgctccgtcaccagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaaattttgtacagcagcaatttcttactctctctgcaagttttcttcccagtcacgagatactttgtgcagctgcttatctccaggccttattaaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaagctcaaggagttatgaccactcagaaaattctgatttggtctttggtggccgcacaggaaatgaggatattatttccagattgcaggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtgacctcaggctggggcggctcctcctccgtgtggccccggatcagcacaccaggctgctgcctttcgctttttacagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcagggcaaccccgtggaactgataacaaaagctcgtctttttctgctgcagttaatacctcggtgcccgaaaaagagcttctcacacgtggcagagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgagggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttccttaaccacagattcttgtcttttttttttttgagatggagtttcgctctgttacccaggctgcagtgcggtggcgtgatctcagctcactgcaacctgcgcctcccgggctcaagcgattcttgtgcctcagcctgccaagtagctgggattacaggcgccccccaccacgcccagctgatttttgtatttttagtagagacagggtttacaccatattggccaggctggtcttgaattcctgaccttgtgatctgcctgcctcggtctcccaaagtgctgggattacatgtgtgagccactgcatccggcctgtgggcttatcttttaatgtcttatttgaggacgtggtgcagcagccttggtgtgggtgctcgaagtccctggcctcctacctgagcctcttctgtccagaggcccagtat

SEQ ID NO: 368744 - DNA, 5991 bp, Homo sapiens
gggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcgcggttgatgtactgcagagaatgctgatttttgcacttgacgctttggctgctggagtacaggaggagtcctccactcacaagatcgtgaggtgctggttcggagtgttcagtggacacacgcttggcagtgtaatttccacagatcctctgaagaggttcttcagtcataccctgactcagatactcactcacagccctgtgctgaaagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggcattcgagagctgccagctggacagcatggtcactgcgttcctggttgtgcgccaggcagcactggagggcccctctgcgttcctgtcatatgcagactggttcaaggcctcctttgggagcacacgaggctaccatggctgcagcaagaaggccctggtcttcctgtttacgttcttgtcagaactcgtgccttttgagtctccccggtacctgcaggtgcacattctccacccacccctggttcccagcaagtaccgctccctcctcacagactacatctcattggccaagacacggctggccgacctcaaggtttctatagaaaacatgggactctacgaggatttgtcatcagctggggacattactgagccccacagccaagctcttcaggatgttgaaaaggccatcatggtgtttgagcatacggggaacatcccagtcaccgtcatggaggccagcatattcaggaggccttactacgtgtcccacttcctccccgccctgctcacacctcgagtgctccccaaagtccctgactcccgtgtggcgtttatagagtctctgaagagagcagataaaatccccccatctctgtactccacctactgccaggcctgctctgctgctgaagagaagccagaagatgcagccctgggagtgagggcagaacccaactctgctgaggagcccctgggacagctcacagctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacatggctgtggacctcctgctgacgtctttctgtcagaacctgatggctgcctccagtgtcgctcccccggagaggcagggtccctgggctgccctcttcgtgaggaccatgtgtggacgtgtgctccctgcagtgctcacccggctctgccagctgctccgtcaccagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaaattttgtacagcagcaatttcttactctctctgcaagttttcttcccagtcacgagatactttgtgcagctgcttatctccaggccttattaaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacgtaggtgaccgttccttctcctgcatcatgccacgtcctgagtctagggtttgtgtgtgctcctcgggcaagaacagcagcacgtggtcatggtgatgtgcacctgcagtcccagccatctgagaggctgagggggagaattctggagttcaggaggcagagtctgcagcgagctacgattgcaccactgcacacactccagcctgggcaacagaacctgtttccaaaaataaatgaagttaacttaccaagactggttacacctggagctggaaattcaacctgaagctgatgctctttcagatactgaacgctcaaggagttatgaccactcagaaaattctgatttggtctttggtggccgcacaggaaatgaggatattatttccagattgcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtgacctcaggctggggcggctcctcctccgtgtggccccggatcagcacaccaggctgctgcctttcgctttttacagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcagggcaaccccgtggaactgataacaaaagctcgtctttttctgctgcagttaatacctcggtgcccgaaaaagagcttctcacacgtggcagagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgagggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttccttaaccacagattcttgtcttttttttttttgagatggagtttcgctctgttacccaggctgcagtgcggtggcgtgatctcagctcactgcaacctgcgcctcccgggctcaagcgattcttgtgcctcagcctgccaagtagctgggattacaggcgccccccaccacgcccagctgatttttgtatttttagtagagacagggtttacaccatattggccaggctggtcttgaattcctgaccttgtgatctgcctgcctcggtctcccaaagtgctgggattacatgtgtgagccactgcatccggcctgtgggcttatcttttaatgtcttatttgaggacgtggtgcagcagccttggtgtgggtgctcgaagtccctggcctcctacctgagcctcttctgtccagaggcccagtat

SEQ ID NO: 368745 - DNA, 4955 bp, Homo sapiens
gggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcgcggttgatgtactgcagagaatgctgatttttgcacttgacgctttggctgctggagtacaggaggagtcctccactcacaagatcgtgaggtgctggttcggagtgttcagtggacacacgcttggcagtgtaatttccacagatcctctgaagaggttcttcagtcataccctgactcagatactcactcacagccctgtgctgaaagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaaggctgtggacctcctgctgacgtctttctgtcagaacctgatggctgcctccagtgtcgctcccccggagaggcagggtccctgggctgccctcttcgtgaggaccatgtgtggacgtgtgctccctgcagtgctcacccggctctgccagctgctccgtcaccagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaaattttgtacagcagcaatttcttactctctctgcaagttttcttcccagtcacgagatactttgtgcagctgcttatctccaggccttattaaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaagctcaaggagttatgaccactcagaaaattctgatttggtctttggtggccgcacaggaaatgaggatattatttccagattgcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtgacctcaggctggggcggctcctcctccgtgtggccccggatcagcacaccaggctgctgcctttcgctttttacagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcagggcaaccccgtggaactgataacaaaagctcgtctttttctgctgcagttaatacctcggtgcccgaaaaagagcttctcacacgtggcagagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgagggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttccttaaccacagattcttgtcttttttttttttgagatggagtttcgctctgttacccaggctgcagtgcggtggcgtgatctcagctcactgcaacctgcgcctcccgggctcaagcgattcttgtgcctcagcctgccaagtagctgggattacaggcgccccccaccacgcccagctgatttttgtatttttagtagagacagggtttacaccatattggccaggctggtcttgaattcctgaccttgtgatctgcctgcctcggtctcccaaagtgctgggattacatgtgtgagccactgcatccggcctgtgggcttatcttttaatgtcttatttgaggacgtggtgcagcagccttggtgtgggtgctcgaagtccctggcctcctacctgagcctcttctgtccagaggcccagtat

SEQ ID NO: 368746 - DNA, 4960 bp, Homo sapiens
ctttctacactctctcgtcgccgcacacggggagagacccaccgaccctgtggggctggtccttaacaaaaacccacaactttttgatctctgacttgaagtttttgtctgtttctccccctgcagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggcattcgagagctgccagctggacagcatggtcactgcgttcctggttgtgcgccaggcagcactggagggcccctctgcgttcctgtcatatgcagactggttcaaggcctcctttgggagcacacgaggctaccatggctgcagcaagaaggccctggtcttcctgtttacgttcttgtcagaactcgtgccttttgagtctccccggtacctgcaggtgcacattctccacccacccctggttcccagcaagtaccgctccctcctcacagactacatctcattggccaagacacggctggccgacctcaaggtttctatagaaaacatgggactctacgaggatttgtcatcagctggggacattactgagccccacagccaagctcttcaggatgttgaaaaggccatcatggtgtttgagcatacggggaacatcccagtcaccgtcatggaggccagcatattcaggaggccttactacgtgtcccacttcctccccgccctgctcacacctcgagtgctccccaaagtccctgactcccgtgtggcgtttatagagtctctgaagagagcagataaaatccccccatctctgtactccacctactgccaggcctgctctgctgctgaagagaagccagaagatgcagccctgggagtgagggcagaacccaactctgctgaggagcccctgggacagctcacagctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacatggctgtggacctcctgctgacgtctttctgtcagaacctgatggctgcctccagtgtcgctcccccggagaggcagggtccctgggctgccctcttcgtgaggaccatgtgtggacgtgtgctccctgcagtgctcacccggctctgccagctgctccgtcaccagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaaattttgtacagcagcaatttcttactctctctgcaagttttcttcccagtcacgagatactttgtgcagctgcttatctccaggccttattaaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaagctcaaggagttatgaccactcagaaaattctgatttggtctttggtggccgcacaggaaatgaggatattatttccagattgcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtgacctcaggctggggcggctcctcctccgtgtggccccggatcagcacaccaggctgctgcctttcgctttttacagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcagggcaaccccgtggaactgataacaaaagctcgtctttttctgctgcagttaatacctcggtgcccgaaaaagagcttctcacacgtggcagagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgagggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttccttaaccacagattcttgtcttttttttttttgagatggagtttcgctctgttacccaggctgcagtgcggtggcgtgatctcagctcactgcaacctgcgcctcccgggctcaagcgattcttgtgcctcagcctgccaagtagctgggattacaggcgccccccaccacgcccagctgatttttgtatttttagtagagacagggtttacaccatattggccaggctggtcttgaattcctgaccttgtgatctgcctgcctcggtctcccaaagtgctgggattacatgtgtgagccactgcatccggcctgtgggcttatcttttaatgtcttatttgaggacgtggtgcagcagccttggtgtgggtgctcgaagtccctggcctcctacctgagcctcttctgtccagaggcccagtat

SEQ ID NO: 368747 - DNA, 6510 bp, Homo sapiens
gggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcgcggttgatgtactgcagagaatgctgatttttgcacttgacgctttggctgctggagtacaggaggagtcctccactcacaagatcgtgaggtgctggttcggagtgttcagtggacacacgcttggcagtgtaatttccacagatcctctgaagaggttcttcagtcataccctgactcagatactcactcacagccctgtgctgaaagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggcattcgagagctgccagctggacagcatggtcactgcgttcctggttgtgcgccaggcagcactggagggcccctctgcgttcctgtcatatgcagactggttcaaggcctcctttgggagcacacgaggctaccatggctgcagcaagaaggccctggtcttcctgtttacgttcttgtcagaactcgtgccttttgagtctccccggtacctgcaggtgcacattctccacccacccctggttcccagcaagtaccgctccctcctcacagactacatctcattggccaagacacggctggccgacctcaaggtttctatagaaaacatgggactctacgaggatttgtcatcagctggggacattactgagccccacagccaagctcttcaggatgttgaaaaggccatcatggtgtttgagcatacggggaacatcccagtcaccgtcatggaggccagcatattcaggaggccttactacgtgtcccacttcctccccgccctgctcacacctcgagtgctccccaaagtccctgactcccgtgtggcgtttatagagtctctgaagagagcagataaaatccccccatctctgtactccacctactgccaggcctgctctgctgctgaagagaagccagaagatgcagccctgggagtgagggcagaacccaactctgctgaggagcccctgggacagctcacagctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacatggctgtggacctcctgctgacgtctttctgtcagaacctgatggctgcctccagtgtcgctcccccggagaggcagggtccctgggctgccctcttcgtgaggaccatgtgtggacgtgtgctccctgcagtgctcacccggctctgccagctgctccgtcaccagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaaattttgtacagcagcaatttcttactctctctgcaagttttcttcccagtcacgagatactttgtgcagctgcttatctccaggccttattaaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaagctcaaggagttatgaccactcagaaaattctgatttggtctttggtggccgcacaggaaatgaggatattatttccagattgcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtggtaagaaacacgctgctgaggcacaaatgcggagggccgctcttttcagaggcatcttgcaaatggttaagaacgagccctccttgaggttccttgctaagtaagtttataagctccattttagttgggacagattaagcacaaacttgtttaaagcaataagataatttactggctcactggtcaaccccaggaccaatgggcctatcatggggactgcctctctctgcaccacacccaccctcctgcaagaggtcgacccccccatcctctcccagctgctgacaggtacctgggtatcctcagctcaggctgttcgccccacactatccccacaggcaggcctcccagggtacacgtcccgacccccaggggtgtccccagcactgataataggcagagatgtccagagttgcctgagccacttcttggtgttgcagacctcaggctggggcggctcctcctccgtgtggccccggatcagcacaccaggctgctgcctttcgctttttacagggtacctccacccacagggctggtcagggctgggcagtgtttcccagacccccatctcagcacctctgggtcccgccagatgggaagggttgtctgtgcctctgctccacagatgagcagtatcccttggcatcacctgctacctttccagcagtctgtagccatttgtcactatgtctttacctctagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcagggcaaccccgtggaactgataacaaaagctcgtctttttctgctgcagttaatacctcggtgcccgaaaaagagcttctcacacgtggcagagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgagggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttccttaaccacagattcttgtcttttttttttttgagatggagtttcgctctgttacccaggctgcagtgcggtggcgtgatctcagctcactgcaacctgcgcctcccgggctcaagcgattcttgtgcctcagcctgccaagtagctgggattacaggcgccccccaccacgcccagctgatttttgtatttttagtagagacagggtttacaccatattggccaggctggtcttgaattcctgaccttgtgatctgcctgcctcggtctcccaaagtgctgggattacatgtgtgagccactgcatccggcctgtgggcttatcttttaatgtcttatttgaggacgtggtgcagcagccttggtgtgggtgctcgaagtccctggcctcctacctgagcctcttctgtccagaggcccagtat

SEQ ID NO: 368748 - DNA, 6837 bp, Homo sapiens
gggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcgcggttgatgtactgcagagaatgctgatttttgcacttgacgctttggctgctggagtacaggaggagtcctccactcacaagatcgtgaggtgctggttcggagtgttcagtggacacacgcttggcagtgtaatttccacagatcctctgaagaggttcttcagtcataccctgactcagatactcactcacagccctgtgctgaaagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggcattcgagagctgccagctggacagcatggtcactgcgttcctggttgtgcgccaggcagcactggagggcccctctgcgttcctgtcatatgcagactggttcaaggcctcctttgggagcacacgaggctaccatggctgcagcaagaaggccctggtcttcctgtttacgttcttgtcagaactcgtgccttttgagtctccccggtacctgcaggtgcacattctccacccacccctggttcccagcaagtaccgctccctcctcacagactacatctcattggccaagacacggctggccgacctcaaggtttctatagaaaacatgggactctacgaggatttgtcatcagctggggacattactgagccccacagccaagctcttcaggatgttgaaaaggccatcatggtgtttgagcatacggggaacatcccagtcaccgtcatggaggccagcatattcaggaggccttactacgtgtcccacttcctccccgccctgctcacacctcgagtgctccccaaagtccctgactcccgtgtggcgtttatagagtctctgaagagagcagataaaatccccccatctctgtactccacctactgccaggcctgctctgctgctgaagagaagccagaagatgcagccctgggagtgagggcagaacccaactctgctgaggagcccctgggacagctcacagctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacatggctgtggacctcctgctgacgtctttctgtcagaacctgatggctgcctccagtgtcgctcccccggagaggcagggtccctgggctgccctcttcgtgaggaccatgtgtggacgtgtgctccctgcagtgctcacccggctctgccagctgctccgtcaccagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaaattttgtacagcagcaatttcttactctctctgcaagttttcttcccagtcacgagatactttgtgcagctgcttatctccaggccttattaaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaagctcaaggagttatgaccactcagaaaattctgatttggtctttggtggccgcacaggaaatgaggatattatttccagattgcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtggtaagaaacacgctgctgaggcacaaatgcggagggccgctcttttcagaggcatcttgcaaatggttaagaacgagccctccttgaggttccttgctaagtaagtttataagctccattttagttgggacagattaagcacaaacttgtttaaagcaataagataatttactggctcactggtcaaccccaggaccaatgggcctatcatggggactgcctctctctgcaccacacccaccctcctgcaagaggtcgacccccccatcctctcccagctgctgacaggtacctgggtatcctcagctcaggctgttcgccccacactatccccacaggcaggcctcccagggtacacgtcccgacccccaggggtgtccccagcactgataataggcagagatgtccagagttgcctgagccacttcttggtgttgcagacctcaggctggggcggctcctcctccgtgtggccccggatcagcacaccaggctgctgcctttcgctttttacagggtacctccacccacagggctggtcagggctgggcagtgtttcccagacccccatctcagcacctctgggtcccgccagatgggaagggttgtctgtgcctctgctccacagatgagcagtatcccttggcatcacctgctacctttccagcagtctgtagccatttgtcactatgtctttacctctagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcaggtgcaagggccagtcccacctccaggggagctccccccagccggaggctccttctgccaaagaatgttccggcacagcatgcagactatgggggacacaccagccctgtttctgtatgtcttctaacctgtgagtttgcctgttttctctctagggcaaccccgtggaactgataacaaaagctcgtctttttctgctgcagttaatacctcggtgcccgaaaaagagcttctcacacgtggcagaggtaacgtcaagatgcccaccttgggccacgtgggggacatgagaattgacagctgcctgggccatgtgcctgcctggctggcaatacaactcgactatttctgccagagcccctcccctgtggtctgaggcctagtgggcggcatgggctgaggacctgctcctctctcacagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgagggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttccttaaccacagattcttgtcttttttttttttgagatggagtttcgctctgttacccaggctgcagtgcggtggcgtgatctcagctcactgcaacctgcgcctcccgggctcaagcgattcttgtgcctcagcctgccaagtagctgggattacaggcgccccccaccacgcccagctgatttttgtatttttagtagagacagggtttacaccatattggccaggctggtcttgaattcctgaccttgtgatctgcctgcctcggtctcccaaagtgctgggattacatgtgtgagccactgcatccggcctgtgggcttatcttttaatgtcttatttgaggacgtggtgcagcagccttggtgtgggtgctcgaagtccctggcctcctacctgagcctcttctgtccagaggcccagtat

SEQ ID NO: 368749 - DNA, 5858 bp, Homo sapiens
gggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcgcggttgatgtactgcagagaatgctgatttttgcacttgacgctttggctgctggagtacaggaggagtcctccactcacaagatcgtgaggtgctggttcggagtgttcagtggacacacgcttggcagtgtaatttccacagatcctctgaagaggttcttcagtcataccctgactcagatactcactcacagccctgtgctgaaagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggcattcgagagctgccagctggacagcatggtcactgcgttcctggttgtgcgccaggcagcactggagggcccctctgcgttcctgtcatatgcagactggttcaaggcctcctttgggagcacacgaggctaccatggctgcagcaagaaggccctggtcttcctgtttacgttcttgtcagaactcgtgccttttgagtctccccggtacctgcaggtgcacattctccacccacccctggttcccagcaagtaccgctccctcctcacagactacatctcattggccaagacacggctggccgacctcaaggtttctatagaaaacatgggactctacgaggatttgtcatcagctggggacattactgagccccacagccaagctcttcaggatgttgaaaaggccatcatggtgtttgagcatacggggaacatcccagtcaccgtcatggaggccagcatattcaggaggccttactacgtgtcccacttcctccccgccctgctcacacctcgagtgctccccaaagtccctgactcccgtgtggcgtttatagagtctctgaagagagcagataaaatccccccatctctgtactccacctactgccaggcctgctctgctgctgaagagaagccagaagatgcagccctgggagtgagggcagaacccaactctgctgaggagcccctgggacagctcacagctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacatggctgtggacctcctgctgacgtctttctgtcagaacctgatggctgcctccagtgtcgctcccccggagaggcagggtccctgggctgccctcttcgtgaggaccatgtgtggacgtgtgctccctgcagtgctcacccggctctgccagctgctccgtcaccagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaaattttgtacagcagcaatttcttactctctctgcaagttttcttcccagtcacgagatactttgtgcagctgcttatctccaggccttattaaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaagctcaaggagttatgaccactcagaaaattctgatttggtctttggtggccgcacaggaaatgaggatattatttccagattgcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtgacctcaggctggggcggctcctcctccgtgtggccccggatcagcacaccaggctgctgcctttcgctttttacagacgcggccatcagggaagaggccttcctgcatgttgctgtggacatgtacttgaagctggtccagctcttcgtggctggggatacaagcacagtttcacctccagctggcaggagcctggagctcaagggtcagggcaaccccgtggaactgataacaaaagctcgtctttttctgctgcagttaatacctcggtgcccgaaaaagagcttctcacacgtggcagagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgagggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttccttaaccacagattcttgtcttttttttttttgagatggagtttcgctctgttacccaggctgcagtgcggtggcgtgatctcagctcactgcaacctgcgcctcccgggctcaagcgattcttgtgcctcagcctgccaagtagctgggattacaggcgccccccaccacgcccagctgatttttgtatttttagtagagacagggtttacaccatattggccaggctggtcttgaattcctgaccttgtgatctgcctgcctcggtctcccaaagtgctgggattacatgtgtgagccactgcatccggcctgtgggcttatcttttaatgtcttatttgaggacgtggtgcagcagccttggtgtgggtgctcgaagtccctggcctcctacctgagcctcttctgtccagaggcccagtat

SEQ ID NO: 368750 - DNA, 2423 bp, Homo sapiens
tggcctgtaggagcactgggggcttgtcatggctggggcagcggaggtgtgtccatctcagccaccctcatctgtgtgctggtgctctctccataggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtgacctcaggctggggcggctcctcctccgtgtggccccggatcagcacaccaggctgctgcctttcgctttttacagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcagggcaaccccgtggaactgataacaaaagctcgtctttttctgctgcagttaatacctcggtgcccgaaaaagagcttctcacacgtggcagagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgagggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttccttaaccacagattcttgtcttttttttttttgagatggagtttcgctctgttacccaggctgcagtgcggtggcgtgatctcagctcactgcaacctgcgcctcccgggctcaagcgattcttgtgcctcagcctgccaagtagctgggattacaggcgccccccaccacgcccagctgatttttgtatttttagtagagacagggtttacaccatattggccaggctggtcttgaattcctgaccttgtgatctgcctgcctcggtctcccaaagtgctgggattacatgtgtgagccactgcatccggcctgtgggcttatcttttaatgtcttatttgaggacgtggtgcagcagccttggtgtgggtgctcgaagtccctggcctcctacctgagcctcttctgtccagaggcccagtat

SEQ ID NO: 368751 - DNA, 5030 bp, Homo sapiens
gggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcgcggttgatgtactgcagagaatgctgatttttgcacttgacgctttggctgctggagtacaggaggagtcctccactcacaagatcgtgaggtgctggttcggagtgttcagtggacacacgcttggcagtgtaatttccacagatcctctgaagaggttcttcagtcataccctgactcagatactcactcacagccctgtgctgaaagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggcattcgagagctgccagctggacagcatggtcactgcgttcctggttgtgcgccaggcagcactggagggcccctctgcgttcctgtcatatgcagactggttcaaggcctcctttgggagcacacgaggctaccatggctgcagcaagaaggccctggtcttcctgtttacgttcttgtcagaactcgtgccttttgagtctccccggtacctgcaggtgcacattctccacccacccctggttcccagcaagtaccgctccctcctcacagactacatctcattggccaagacacggctggccgacctcaaggtttctatagaaaacatgggactctacgaggatttgtcatcagctggggacattactgagccccacagccaagctcttcaggatgttgaaaaggccatcatggtgtttgagcatacggggaacatcccagtcaccgtcatggaggccagcatattcaggaggccttactacgtgtcccacttcctccccgccctgctcacacctcgagtgctccccaaagtccctgactcccgtgtggcgtttatagagtctctgaagagagcagataaaatccccccatctctgtactccacctactgccaggcctgctctgctgctgaagagaagccagaagatgcagccctgggagtgagggcagaacccaactctgctgaggagcccctgggacagctcacagctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacatggctgtggacctcctgctgacgtctttctgtcagaacctgatggctgcctccagtgtcgctcccccggagaggcagggtccctgggctgccctcttcgtgaggaccatgtgtggacgtgtgctccctgcagtgctcacccggctctgccagctgctccgtcaccagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaaattttgtacagcagcaatttcttactctctctgcaagttttcttcccagtcacgagatactttgtgcagctgcttatctccaggccttattaaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaagctcaaggagttatgaccactcagaaaattctgatttggtctttggtggccgcacaggaaatgaggatattatttccagattgcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtggtaagaaacacgctgctgaggcacaaatgcggagggccgctcttttcagaggcatcttgcaaatggttaagaacgagccctccttgaggttccttgctaagtaagtttataagctccattttagttgggacagattaagcacaaacttgtttaaagcaataagataatttactggctcactggtcaaccccaggaccaatgggcctatcatggggactgcctctctctgcaccacacccaccctcctgcaagaggtcgacccccccatcctctcccagctgctgacaggtacctgggtatcctcagctcaggctgttcgccccacactatccccacaggcaggcctcccagggtacacgtcccgacccccaggggtgtccccagcactgataataggcagagatgtccagagttgcctgagccacttcttggtgttgcagacctcaggctggggcggctcctcctccgtgtggccccggatcagcacaccaggctgctgcctttcgctttttacagggtacctccacccacagggctggtcagggctgggcagtgtttcccagacccccatctcagcacctctgggtcccgccagatgggaagggttgtctgtgcctctgctccacagatgagcagtatcccttggcatcacctgctacctttccagcagtctgtagccatttgtcactatgtctttacctctagtcttctctcctacttccatgaagacgcggccatcagggaagaggccttcctgcatgttgctgtggacatgtacttgaagctggtccagctcttcgtggctggggataacatcacatgttatcgcccaacacgagatatgaatccattaacactgacatacaattgaccagctgttatagagccattcttgtatcactgaaaggctgaaatgggggaaaagagagaaacagactggctagaatacacagctcctctagtggcattcctgttataacaacctcataggtacagagatgccgctgatcactcctagatttcagtaatatataataacctaattaatcacgtcg

SEQ ID NO: 368752 - DNA, 4650 bp, Homo sapiens
gggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcgcggttgatgtactgcagagaatgctgatttttgcacttgacgctttggctgctggagtacaggaggagtcctccactcacaagatcgtgaggtgctggttcggagtgttcagtggacacacgcttggcagtgtaatttccacagatcctctgaagaggttcttcagtcataccctgactcagatactcactcacagccctgtgctgaaagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggcattcgagagctgccagctggacagcatggtcactgcgttcctggttgtgcgccaggcagcactggagggcccctctgcgttcctgtcatatgcagactggttcaaggcctcctttgggagcacacgaggctaccatggctgcagcaagaaggccctggtcttcctgtttacgttcttgtcagaactcgtgccttttgagtctccccggtacctgcaggtgcacattctccacccacccctggttcccagcaagtaccgctccctcctcacagactacatctcattggccaagacacggctggccgacctcaaggtttctatagaaaacatgggactctacgaggatttgtcatcagctggggacattactgagccccacagccaagctcttcaggatgttgaaaaggccatcatggtgtttgagcatacggggaacatcccagtcaccgtcatggaggccagcatattcaggaggccttactacgtgtcccacttcctccccgccctgctcacacctcgagtgctccccaaagtccctgactcccgtgtggcgtttatagagtctctgaagagagcagataaaatccccccatctctgtactccacctactgccaggcctgctctgctgctgaagagaagccagaagatgcagccctgggagtgagggcagaacccaactctgctgaggagcccctgggacagctcacagctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacatggctgtggacctcctgctgacgtctttctgtcagaacctgatggctgcctccagtgtcgctcccccggagaggcagggtccctgggctgccctcttcgtgaggaccatgtgtggacgtgtgctccctgcagtgctcacccggctctgccagctgctccgtcaccagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaaattttgtacagcagcaatttcttactctctctgcaagttttcttcccagtcacgagatactttgtgcagctgcttatctccaggccttattaaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaagctcaaggagttatgaccactcagaaaattctgatttggtctttggtggccgcacaggaaatgaggatattatttccagattgcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtggtaagaaacacgctgctgaggcacaaatgcggagggccgctcttttcagaggcatcttgcaaatggttaagaacgagccctccttgaggttccttgctaagtaagtttataagctccattttagttgggacagattaagcacaaacttgtttaaagcaataagataatttactggctcactggtcaaccccaggaccaatgggcctatcatggggactgcctctctctgcaccacacccaccctcctgcaagaggtcgacccccccatcctctcccagctgctgacaggtacctgggtatcctcagctcaggctgttcgccccacactatccccacaggcaggcctcccagggtacacgtcctcaaataagacattaaaagaaaggcccaaatggccgggcgcggtggctcacgcctgtaatcccagcactttgggaggccgaggtgggcggatcacgaggtcaggagatcaagaccatcctggctaacacggtgaaaccccgtctctactaaaaatacaaaaaatcagccgggcgtggtggcccgcacctgtagtcccagctactcgggaggctgaggcgggagaatggcgtgaacctgagaggcagaggttgcagtgagctgagatcgtgccactgcactccagcctggacgacagagagaaactccgtctca

SEQ ID NO: 368753 - DNA, 3617 bp, Homo sapiens
  misc_feature (3595)..(3595): n is a, c, g, or t
gggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcgcggttgatgtactgcagagaatgctgatttttgcacttgacgctttggctgctggagtacaggaggagtcctccactcacaagatcgtgaggtgctggttcggagtgttcagtggacacacgcttggcagtgtaatttccacagatcctctgaagaggttcttcagtcataccctgactcagatactcactcacagccctgtgctgaaagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggcattcgagagctgccagctggacagcatggtcactgcgttcctggttgtgcgccaggcagcactggagggcccctctgcgttcctgtcatatgcagactggttcaaggcctcctttgggagcacacgaggctaccatggctgcagcaagaaggccctggtcttcctgtttacgttcttgtcagaactcgtgccttttgagtctccccggtacctgcaggtgcacattctccacccacccctggttcccagcaagtaccgctccctcctcacagactacatctcattggccaagacacggctggccgacctcaaggtttctatagaaaacatgggactctacgaggatttgtcatcagctggggacattactgagccccacagccaagctcttcaggatgttgaaaaggccatcatggtgtttgagcatacggggaacatcccagtcaccgtcatggaggccagcatattcaggaggccttactacgtgtcccacttcctccccgccctgctcacacctcgagtgctccccaaagtccctgactcccgtgtggcgtttatagagtctctgaagagagcagataaaatccccccatctctgtactccacctactgccaggcctgctctgctgctgaagagaagccagaagatgcagccctgggagtgagggcagaacccaactctgctgaggagcccctgggacagctcacagctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacatggctgtggacctcctgctgacgtctttctgtcagaacctgatggctgcctccagtgtcgctcccccggagaggcagggtccctgggctgccctcttcgtgaggaccatgtgtggacgtgtgctccctgcagtgctcacccggctctgccagctgctccgtcaccagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaaattttgtacagcagcaatttcttactctctctgcaagttttcttcccagtcacgagatactttgtgcagctgcttatctccaggccttattaaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaagctcaaggagttatgaccactcagaaaattctgatttggtctttggtggccgcacaggaaatgaggatattatttccagattgcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtttttggttgggccccaaaccctggaaaccctgttgcttngctccttcccggttggaaagaa

SEQ ID NO: 368754 - DNA, 3113 bp, Homo sapiens
gggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcgcggttgatgtactgcagagaatgctgatttttgcacttgacgctttggctgctggagtacaggaggagtcctccactcacaagatcgtgaggtgctgagcttcagcagcccgctcctgagcacacttcctctgccagttacgataacgtgcgtgaggaggaggcgaccatgggaaagcccggggaacgctctggtcagccttttcctgtgaggatgaggtcggaaggtgcgcccactgcagtatcctgttccgcctctggaagtcctgcaccaatgtttgtcccactcactgtgacctcctcctgtgtggagtctccccttgctcctccttccctgggtgtggttcaggctctagagctggccctgcctctcagccccccacatttctagaacacactgtagctgtgcctctacagactcccgctgcctggcctccacagatcctgctcagattcaccagtaggcaaagcttggccctatttgctttttctctccatggctctgtggagatgtgcggagacccttacaggtcgggaggcggaagctgaggagtgggggctgggtggaaggtggacatcggggtttggtggaaatggggctctggggtttgcttccctctagtgtgggcaggggaccttgaagtgaagtcttgagaaaccagtagaatttgccactgtttccaggccttgtcaaccttttcattctttattttgctcctcatttcccatccctcacagtaactgtttaactgctcaattaaatgtgttgtaccgttcggtacttttactgaaaaaaaaaaaaaaaaaactcgagtttttttttttttttttttttcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgagggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttccttaaccacagattcttgtcttttttttttttgagatggagtttcgctctgttacccaggctgcagtgcggtggcgtgatctcagctcactgcaacctgcgcctcccgggctcaagcgattcttgtgcctcagcctgccaagtagctgggattacaggcgccccccaccacgcccagctgatttttgtatttttagtagagacagggtttacaccatattggccaggctggtcttgaattcctgaccttgtgatctgcctgcctcggtctcccaaagtgctgggattacatgtgtgagccactgcatccggcctgtgggcttatcttttaatgtcttatttgaggacgtggtgcagcagccttggtgtgggtgctcgaagtccctggcctcctacctgagcctcttctgtccagaggcccagtat

SEQ ID NO: 368755 - DNA, 1970 bp, Homo sapiens
agcggcccggggtgagacccacgttaaaagtggcgttttggttacaaattgggacagcccttaaacccaaatcggggcaatcctttgggttataagggattttgcccaattcgggctattggttaaaaaattagctgtttttaccaaaattttacccgaattttaaccagatatttacccttacaattttcaattggcaatcaagctgggccactttttgaaaggccattcgttcgggcccttttggtttttccccaactggcgaaaaggggattttcttcaaagcgatttagttggggaaccccaaggtttttccaattacgacgtttttaaaccgcggcccattaaatgtaaaacggtcccctttaaggcgtattggcccaattagcttttattttttgccgcttgtattaattttttttattttaaatttttttttgttttttttttttttttttttttttttttttttttttttttttttttttttttttttttttttttttttttttttttttttttttttttcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgagggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttccttaaccacagattcttgtcttttttttttttgagatggagtttcgctctgttacccaggctgcagtgcggtggcgtgatctcagctcactgcaacctgcgcctcccgggctcaagcgattcttgtgcctcagcctgccaagtagctgggattacaggcgccccccaccacgcccagctgatttttgtatttttagtagagacagggtttacaccatattggccaggctggtcttgaattcctgaccttgtgatctgcctgcctcggtctcccaaagtgctgggattacatgtgtgagccactgcatccggcctgtgggcttatcttttaatgtcttatttgaggacgtggtgcagcagccttggtgtgggtgctcgaagtccctggcctcctacctgagcctcttctgtccagaggcccagtat

SEQ ID NO: 368756 - DNA, 1976 bp, Homo sapiens
gggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcgcggttgatgtactgcagagaatgctgatttttgcacttgacgctttggctgctggagtacaggaggagtcctccactcacaagatcgtgaggtgctgagcttcagcagcccgctcctgagcacacttcctctgccagttacgataacgtgcgtgaggaggaggcgaccatgggaaagcccggggaacgctctggtcagccttttcctgtgaggatgaggtcggaaggtgcgcccactgcagtatcctgttccgcctctggaagtcctgcaccaatgtttgtcccactcactgtgacctcctcctgtgtggagtctccccttgctcctccttccctgggtgtggttcaggctctagagctggccctgcctctcagccccccacatttctagaacacactgtagctgtgcctctacagactcccgctgcctggcctccacagatcctgctcagattcaccagtaggcaaagcttggccctatttgctttttctctccatggctctgtggagatgtgcggagacccttacaggtcgggaggcggaagctgaggagtgggggctgggtggaaggtggacatcggggtttggtggaaatggggctctggggtttgcttccctctagtgtgggcaggggaccttgaagtgaagtcttgagaaaccagtagaatttgccactgtttccaggccttgtcaaccttttcattctttattttgctcctcatttcccatccctcacagtaactgtttaactgctcaattaaatgtgttgtaccgttcggtacttttactgaaacagtgaataaagcactgtgtgatttcctgaatgtttacatgtgcatcagttagcttgggctgctgtaacaaagtgccagagactgcggtgtggacggcagatgtgttctcacagcagtggaggctggaagttggaggtcagggtgcccctagggttgggttctggtgaggaccctcttcctggcttgcaggagacctactttttctgtgtcttcatgaggtagagaggggagagcaagccctctggtgtcttctccgggcagtcatctcatcatcacctcagccttatcaacaccccaccttgagaggctgggcttcaacagaggaactttgtggggatacagttta

SEQ ID NO: 368757 - DNA, 737 bp, Homo sapiens
gaaagcgcctggggattgtttctggtgggctgccgccgtgtgctgacatctgttttctgttcctggctctgtcttcagttgcacttgacgctttggctgctggagtacaggaggagtcctccactcacaagatcgtgaggtgctggtatgttcctgagggtggcctgcctgagtgtgcagcagggaggtgtctgccaaattaaagagccaagatattttaaacacttccagagcttcagcagcccgctcctgagcacacttcctctgccagttacgataacgtgcgtgaggaggaggcgaccatgggaaagcccggggaacgctctggtcagccttttcctgtgaggatgaggtcggaaggtgcgcccactgcagtatcctgttccgcctctggaagtcctgcaccaatgtttgtcccactcactgtgacctcctcctgtgtggagtctccccttgctcctccttccctgggtgtggttcaggctctagagctggccctgcctctcagccccccacatttctagaacacactgtagctgtgcctctacagactcccgctgcctggcctccacagatcctgctcagattcaccagtaggcaaagcttggccctatttgctttttctctccatggctctgtggagatgtgcggagacccttacaggtcgggaggcggaagctgaggagtgggggctgggtggaaggtggacatcggggtttggtggaaatggggctctg

SEQ ID NO: 368758 - DNA, 334 bp, Homo sapiens
agccagggcgccaggcccggtcagcccaggagcaccatccatggtggccacgccaagccttagcgagtgtttttctcaaaactgaatccacagcagccactctgcatgttggtctcgcctctcttcctgtgggcttttcttacctgccttgaactcttttgcagagaaacttctgctcccacggaggtgccctgacacaggacatcactgcccacttcttcagggtgagatgctccctcagcccctctcgtggccttctcagaacgccgtgggtggatcctcctgtcagcttcctgtgagttccttcactctactagttgtgggtcctcacaaa

SEQ ID NO: 368759 - DNA, 779 bp, Homo sapiens
cgcagggagccgccgccggggctgtaggcgccaaggccatgtccgactcgtgggtcccgaactccgcctcgggccaggacccagggggccgccggagggcctgggccgagctgctgggtaggtgggcgcggcaggccgcgggagtgggcggcgtccggcccgggacggtttcgccggttccccgatcccttcccgccagagcctccgccggtcggatccccggacgccgcgcccggggggctgtgcggggtgggcgcccggctggggcggcgcggctgcctcggacccggcccctcctgcgcctgggcggacgcccaccagaccgccgcccgcggggcgctcccttctttcccgaacgccgcccccgccggccgccctgtcaggcgggcctggggtgcgcggcctggggctcccctcagcgcagaggccgcccctcgccagccgtccccgggctcccctgcctcgggccctcctgggccgtcttccccggcgtccgcggtggggccgtctccgttagtttcccgagacctgcgccctggggaggagccccggcccctcttcgggagggtgtcgctggtgggtttctccgcggcgtccacctgcgcgtcgggccggggaccccgtgtgtgaattgtgctgtgatggtttcgaaccgacttctctccgtagcgggaagggtcaagagggaaaaatataatcctgaaagggcacagaaattaaaggaatcagctgtgcgcctcctgcgaagccatcaggacctgaatgcccttttgcttgag

SEQ ID NO: 368760 - DNA, 1655 bp, Homo sapiens
gggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcgcggttgatgtactgcagagaatgctgatttttgcacttgacgctttggctgctggagtacaggaggagtcctccactcacaagatcgtgaggtgctgagcttcagcagcccgctcctgagcacacttcctctgccagttacgataacgtgcgtgaggaggaggcgaccatgggaaagcccggggaacgctctggtcagccttttcctgtgaggatgaggtcggaaggtgcgcccactgcagtatcctgttccgcctctggaagtcctgcaccaatgtttgtcccactcactgtgacctcctcctgtgtggagtctccccttgctcctccttccctgggtgtggttcaggctctagagctggccctgcctctcagccccccacatttctagaacacactgtagctgtgcctctacagactcccgctgcctggcctccacagatcctgctcagattcaccagtaggcaaagcttggccctatttgctttttctctccatggctctgtggagatgtgcggagacccttacaggtcgggaggcggaagctgaggagtgggggctgggtggaaggtggacatcggggtttggtggaaatggggctctggggtttgcttccctctagtgtgggcaggggaccttgaagtgaagtcttgagaaaccagtagaatttgccactgtttccaggccttgtcaaccttttcattctttattttgctcctcatttcccatccctcacagtaactgtttaactgctcaattaaatgtgttgtaccgttcggtacttttactgaaacagtgaataaagcactgtgtgatttc

SEQ ID NO: 368761 - DNA, 6037 bp, Homo sapiens
gggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcgcggttgatgtactgcagagaatgctgatttttgcacttgacgctttggctgctggagtacaggaggagtcctccactcacaagatcgtgaggtgctggttcggagtgttcagtggacacacgcttggcagtgtaatttccacagatcctctgaagaggttcttcagtcataccctgactcagatactcactcacagccctgtgctgaaagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggcattcgagagctgccagctggacagcatggtcactgcgttcctggttgtgcgccaggcagcactggagggcccctctgcgttcctgtcatatgcagactggttcaaggcctcctttgggagcacacgaggctaccatggctgcagcaagaaggccctggtcttcctgtttacgttcttgtcagaactcgtgccttttgagtctccccggtacctgcaggtgcacattctccacccacccctggttcccagcaagtaccgctccctcctcacagactacatctcattggccaagacacggctggccgacctcaaggtttctatagaaaacatgggactctacgaggatttgtcatcagctggggacattactgagccccacagccaagctcttcaggatgttgaaaaggccatcatggtgtttgagcatacggggaacatcccagtcaccgtcatggaggccagcatattcaggaggccttactacgtgtcccacttcctccccgccctgctcacacctcgagtgctccccaaagtccctgactcccgtgtggcgtttatagagtctctgaagagagcagataaaatccccccatctctgtactccacctactgccaggcctgctctgctgctgaagagaagccagaagatgcagccctgggagtgagggcagaacccaactctgctgaggagcccctgggacagctcacagctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacatggctgtggacctcctgctgacgtctttctgtcagaacctgatggctgcctccagtgtcgctcccccggagaggcagggtccctgggctgccctcttcgtgaggaccatgtgtggacgtgtgctccctgcagtgctcacccggctctgccagctgctccgtcaccagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaaattttgtacagcagcaatttcttactctctctgcaagttttcttcccagtcacgagatactttgtgcagctgcttatctccaggccttattaaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacgtggtcatggtgatgtgcacctgcagtcccagccatctgagaggctgagggggagaattctggagttcaggaggcagagtctgcagcgagctacgattgcaccactgcacacactccagcctgggcaacagaacctgtttccaaaaataaatgaagttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaagctcaaggagttatgaccactcagaaaattctgatttggtctttggtggccgcacaggaaatgaggatattatttccagattgcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtgacctcaggctggggcggctcctcctccgtgtggccccggatcagcacaccaggctgctgcctttcgctttttacagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcagggcaaccccgtggaactgataacaaaagctcgtctttttctgctgcagttaatacctcggtgcccgaaaaagagcttctcacacgtggcagagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgagggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttccttaaccacagattcttgtcttttttttttttgagatggagtttcgctctgttacccaggctgcagtgcggtggcgtgatctcagctcactgcaacctgcgcctcccgggctcaagcgattcttgtgcctcagcctgccaagtagctgggattacaggcgccccccaccacgcccagctgatttttgtatttttagtagagacagggtttacaccatattggccaggctggtcttgaattcctgaccttgtgatctgcctgcctcggtctcccaaagtgctgggattacatgtgtgagccactgcatccggcctgtgggcttatcttttaatgtcttatttgaggacgtggtgcagcagccttggtgtgggtgctcgaagtccctggcctcctacctgagcctcttctgtccagaggcccagtat

SEQ ID NO: 368762 - DNA, 5752 bp, Homo sapiens
gggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcgcggttgatgtactgcagagaatgctgatttttgcacttgacgctttggctgctggagtacaggaggagtcctccactcacaagatcgtgaggtgctggttcggagtgttcagtggacacacgcttggcagtgtaatttccacagatcctctgaagaggttcttcagtcataccctgactcagatactcactcacagccctgtgctgaaagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggcattcgagagctgccagctggacagcatggtcactgcgttcctggttgtgcgccaggcagcactggagggcccctctgcgttcctgtcatatgcagactggttcaaggcctcctttgggagcacacgaggctaccatggctgcagcaagaaggccctggtcttcctgtttacgttcttgtcagaactcgtgccttttgagtctccccggtacctgcaggtgcacattctccacccacccctggttcccagcaagtaccgctccctcctcacagactacatctcattggccaagacacggctggccgacctcaaggtttctatagaaaacatgggactctacgaggatttgtcatcagctggggacattactgagccccacagccaagctcttcaggatgttgaaaaggccatcatggtgtttgagcatacggggaacatcccagtcaccgtcatggaggccagcatattcaggaggccttactacgtgtcccacttcctccccgccctgctcacacctcgagtgctccccaaagtccctgactcccgtgtggcgtttatagagtctctgaagagagcagataaaatccccccatctctgtactccacctactgccaggcctgctctgctgctgaagagaagccagaagatgcagccctgggagtgagggcagaacccaactctgctgaggagcccctgggacagctcacagctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacatggctgtggacctcctgctgacgtctttctgtcagaacctgatggctgcctccagtgtcgctcccccggagaggcagggtccctgggctgccctcttcgtgaggaccatgtgtggacgtgtgctccctgcagtgctcacccggctctgccagctgctccgtcaccagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaaattttgtacagcagcaatttcttactctctctgcaagttttcttcccagtcacgagatactttgtgcagctgcttatctccaggccttattaaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacgctcaaggagttatgaccactcagaaaattctgatttggtctttggtggccgcacaggaaatgaggatattatttccagattgcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtgacctcaggctggggcggctcctcctccgtgtggccccggatcagcacaccaggctgctgcctttcgctttttacagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcagggcaaccccgtggaactgataacaaaagctcgtctttttctgctgcagttaatacctcggtgcccgaaaaagagcttctcacacgtggcagagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgagggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttccttaaccacagattcttgtcttttttttttttgagatggagtttcgctctgttacccaggctgcagtgcggtggcgtgatctcagctcactgcaacctgcgcctcccgggctcaagcgattcttgtgcctcagcctgccaagtagctgggattacaggcgccccccaccacgcccagctgatttttgtatttttagtagagacagggtttacaccatattggccaggctggtcttgaattcctgaccttgtgatctgcctgcctcggtctcccaaagtgctgggattacatgtgtgagccactgcatccggcctgtgggcttatcttttaatgtcttatttgaggacgtggtgcagcagccttggtgtgggtgctcgaagtccctggcctcctacctgagcctcttctgtccagaggcccagtat

SEQ ID NO: 368763 - DNA, 5813 bp, Homo sapiens
  misc_feature (31)..(32): n is a, c, g, or t
taacttacggctaggtacgaggctgggtgtnnagggctgggcgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcgcggttgatgtactgcagagaatgctgatttttgcacttgacgctttggctgctggagtacaggaggagtcctccactcacaagatcgtgaggtgctggttcggagtgttcagtggacacacgcttggcagtgtaatttccacagatcctctgaagaggttcttcagtcataccctgactcagatactcactcacagccctgtgctgaaagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggcattcgagagctgccagctggacagcatggtcactgcgttcctggttgtgcgccaggcagcactggagggcccctctgcgttcctgtcatatgcagactggttcaaggcctcctttgggagcacacgaggctaccatggctgcagcaagaaggccctggtcttcctgtttacgttcttgtcagaactcgtgccttttgagtctccccggtacctgcaggtgcacattctccacccacccctggttcccagcaagtaccgctccctcctcacagactacatctcattggccaagacacggctggccgacctcaaggtttctatagaaaacatgggactctacgaggatttgtcatcagctggggacattactgagccccacagccaagctcttcaggatgttgaaaaggccatcatggtgtttgagcatacggggaacatcccagtcaccgtcatggaggccagcatattcaggaggccttactacgtgtcccacttcctccccgccctgctcacacctcgagtgctccccaaagtccctgactcccgtgtggcgtttatagagtctctgaagagagcagataaaatccccccatctctgtactccacctactgccaggcctgctctgctgctgaagagaagccagaagatgcagccctgggagtgagggcagaacccaactctgctgaggagcccctgggacagctcacagctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacatggctgtggacctcctgctgacgtctttctgtcagaacctgatggctgcctccagtgtcgctcccccggagaggcagggtccctgggctgccctcttcgtgaggaccatgtgtggacgtgtgctccctgcagtgctcacccggctctgccagctgctccgtcaccagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaaattttgtacagcagcaatttcttactctctctgcaagttttcttcccagtcacgagatactttgtgcagctgcttatctccaggccttattaaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaagctcaaggagttatgaccactcagaaaattctgatttggtctttggtggccgcacaggaaatgaggatattatttccagattgcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtgacctcaggctggggcggctcctcctccgtgtggccccggatcagcacaccaggctgctgcctttcgctttttacagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcagggcaaccccgtggaactgataacaaaagctcgtctttttctgctgcagttaatacctcggtgcccgaaaaagagcttctcacacgtggcagagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgagggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttccttaaccacagattcttgtcttttttttttttgagatggagtttcgctctgttacccaggctgcagtgcggtggcgtgatctcagctcactgcaacctgcgcctcccgggctcaagcgattcttgtgcctcagcctgccaagtagctgggattacaggcgccccccaccacgcccagctgatttttgtatttttagtagagacagggtttacaccatattggccaggctggtcttgaattcctgaccttgtgatctgcctgcctcggtctcccaaagtgctgggattacatgtgtgagccactgcatccggcctgtgggcttatcttttaatgtcttatttgaggacgtggtgcagcagccttggtgtgggtgctcgaagtccctggcctcctacctgagcctcttctgtccagaggcccagtat

SEQ ID NO: 368764 - DNA, 5818 bp, Homo sapiens
gggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcgcggttgatgtactgcagagaatgctgatttttgcacttgacgctttggctgctggagtacaggaggagtcctccactcacaagatcgtgaggtgctggttcggagtgttcagtggacacacgcttggcagtgtaatttccacagatcctctgaagaggttcttcagtcataccctgactcagatactcactcacagccctgtgctgaaagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggcattcgagagctgccagctggacagcatggtcactgcgttcctggttgtgcgccaggcagcactggagggcccctctgcgttcctgtcatatgcagactggttcaaggcctcctttgggagcacacgaggctaccatggctgcagcaagaaggccctggtcttcctgtttacgttcttgtcagaactcgtgccttttgagtctccccggtacctgcaggtgcacattctccacccacccctggttcccagcaagtaccgctccctcctcacagactacatctcattggccaagacacggctggccgacctcaaggtttctatagaaaacatgggactctacgaggatttgtcatcagctggggacattactgagccccacagccaagctcttcaggatgttgaaaaggccatcatggtgtttgagcatacggggaacatcccagtcaccgtcatggaggccagcatattcaggaggccttactacgtgtcccacttcctccccgccctgctcacacctcgagtgctccccaaagtccctgactcccgtgtggcgtttatagagtctctgaagagagcagataaaatccccccatctctgtactccacctactgccaggcctgctctgctgctgaagagaagccagaagatgcagccctgggagtgagggcagaacccaactctgctgaggagcccctgggacagctcacagctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacatggctgtggacctcctgctgacgtctttctgtcagaacctgatggctgcctccagtgtcgctcccccggagaggcagggtccctgggctgccctcttcgtgaggaccatgtgtggacgtgtgctccctgcagtgctcacccggctctgccagctgctccgtcaccagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaaattttgtacagcagcaatttcttactctctctgcaagttttcttcccagtcacgagatactttgtgcagctgcttatctccaggccttattaaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaagctcaaggagttatgaccactcagaaaattctgatttggtctttggtggccgcacaggaaatgaggatattatttccagattgcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagagcaccacagacctgccaaaggctttccacgtttgtgcagcaatcctcgagtgtttagagaagaggaagatatcctggctggcactctttcagttgacagagagtgacctcaggctggggcggctcctcctccgtgtggccccggatcagcacaccaggctgctgcctttcgctttttacagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcagggcaaccccgtggaactgataacaaaagctcgtctttttctgctgcagttaatacctcggtgcccgaaaaagagcttctcacacgtggcagagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgagggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttccttaaccacagattcttgtcttttttttttttgagatggagtttcgctctgttacccaggctgcagtgcggtggcgtgatctcagctcactgcaacctgcgcctcccgggctcaagcgattcttgtgcctcagcctgccaagtagctgggattacaggcgccccccaccacgcccagctgatttttgtatttttagtagagacagggtttacaccatattggccaggctggtcttgaattcctgaccttgtgatctgcctgcctcggtctcccaaagtgctgggattacatgtgtgagccactgcatccggcctgtgggcttatcttttaatgtcttatttgaggacgtggtgcagcagccttggtgtgggtgctcgaagtccctggcctcctacctgagcctcttctgtccagaggcccagtat

SEQ ID NO: 368765 - DNA, 6321 bp, Homo sapiens
gggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcgcggttgatgtactgcagagaatgctgatttttgcacttgacgctttggctgctggagtacaggaggagtcctccactcacaagatcgtgaggtgctggttcggagtgttcagtggacacacgcttggcagtgtaatttccacagatcctctgaagaggttcttcagtcataccctgactcagatactcactcacagccctgtgctgaaagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggcattcgagagctgccagctggacagcatggtcactgcgttcctggttgtgcgccaggcagcactggagggcccctctgcgttcctgtcatatgcagactggttcaaggcctcctttgggagcacacgaggctaccatggctgcagcaagaaggccctggtcttcctgtttacgttcttgtcagaactcgtgccttttgagtctccccggtacctgcaggtgcacattctccacccacccctggttcccagcaagtaccgctccctcctcacagactacatctcattggccaagacacggctggccgacctcaaggtttctatagaaaacatgggactctacgaggatttgtcatcagctggggacattactgagccccacagccaagctcttcaggatgttgaaaaggccatcatggtgtttgagcatacggggaacatcccagtcaccgtcatggaggccagcatattcaggaggccttactacgtgtcccacttcctccccgccctgctcacacctcgagtgctccccaaagtccctgactcccgtgtggcgtttatagagtctctgaagagagcagataaaatccccccatctctgtactccacctactgccaggcctgctctgctgctgaagagaagccagaagatgcagccctgggagtgagggcagaacccaactctgctgaggagcccctgggacagctcacagctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacatggctgtggacctcctgctgacgtctttctgtcagaacctgatggctgcctccagtgtcgctcccccggagaggcagggtccctgggctgccctcttcgtgaggaccatgtgtggacgtgtgctccctgcagtgctcacccggctctgccagctgctccgtcaccagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaaattttgtacagcagcaatttcttactctctctgcaagttttcttcccagtcacgagatactttgtgcagctgcttatctccaggccttattaaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaagctcaaggagttatgaccactcagaaaattctgatttggtctttggtggccgcacaggaaatgaggatattatttccagattgcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtggtaagaaacacgctgctgaggcacaaatgcggagggccgctcttttcagaggcatcttgcaaatggttaagaacgagccctccttgaggttccttgctaagtaagtttataagctccattttagttgggacagattaagcacaaacttgtttaaagcaataagataatttactggctcactggtcaaccccaggaccaatgggcctatcatggggactgcctctctctgcaccacacccaccctcctgcaagaggtcgacccccccatcctctcccagctgctgacaggtacctgggtatcctcagctcaggctgttcgccccacactatccccacaggcaggcctcccagggtacacgtcccgacccccaggggtgtccccagcactgataataggcagagatgtccagagttgcctgagccacttcttggtgttgcagacctcaggctggggcggctcctcctccgtgtggccccggatcagcacaccaggctgctgcctttcgctttttacagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcagggcaaccccgtggaactgataacaaaagctcgtctttttctgctgcagttaatacctcggtgcccgaaaaagagcttctcacacgtggcagagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgagggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttccttaaccacagattcttgtcttttttttttttgagatggagtttcgctctgttacccaggctgcagtgcggtggcgtgatctcagctcactgcaacctgcgcctcccgggctcaagcgattcttgtgcctcagcctgccaagtagctgggattacaggcgccccccaccacgcccagctgatttttgtatttttagtagagacagggtttacaccatattggccaggctggtcttgaattcctgaccttgtgatctgcctgcctcggtctcccaaagtgctgggattacatgtgtgagccactgcatccggcctgtgggcttatcttttaatgtcttatttgaggacgtggtgcagcagccttggtgtgggtgctcgaagtccctggcctcctacctgagcctcttctgtccagaggcccagtat

SEQ ID NO: 368766 - DNA, 6683 bp, Homo sapiens
gggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcgcggttgatgtactgcagagaatgctgatttttgcacttgacgctttggctgctggagtacaggaggagtcctccactcacaagatcgtgaggtgctggttcggagtgttcagtggacacacgcttggcagtgtaatttccacagatcctctgaagaggttcttcagtcataccctgactcagatactcactcacagccctgtgctgaaagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggcattcgagagctgccagctggacagcatggtcactgcgttcctggttgtgcgccaggcagcactggagggcccctctgcgttcctgtcatatgcagactggttcaaggcctcctttgggagcacacgaggctaccatggctgcagcaagaaggccctggtcttcctgtttacgttcttgtcagaactcgtgccttttgagtctccccggtacctgcaggtgcacattctccacccacccctggttcccagcaagtaccgctccctcctcacagactacatctcattggccaagacacggctggccgacctcaaggtttctatagaaaacatgggactctacgaggatttgtcatcagctggggacattactgagccccacagccaagctcttcaggatgttgaaaaggccatcatggtgtttgagcatacggggaacatcccagtcaccgtcatggaggccagcatattcaggaggccttactacgtgtcccacttcctccccgccctgctcacacctcgagtgctccccaaagtccctgactcccgtgtggcgtttatagagtctctgaagagagcagataaaatccccccatctctgtactccacctactgccaggcctgctctgctgctgaagagaagccagaagatgcagccctgggagtgagggcagaacccaactctgctgaggagcccctgggacagctcacagctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacatggctgtggacctcctgctgacgtctttctgtcagaacctgatggctgcctccagtgtcgctcccccggagaggcagggtccctgggctgccctcttcgtgaggaccatgtgtggacgtgtgctccctgcagtgctcacccggctctgccagctgctccgtcaccagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaaattttgtacagcagcaatttcttactctctctgcaagttttcttcccagtcacgagatactttgtgcagctgcttatctccaggccttattaaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaagctcaaggagttatgaccactcagaaaattctgatttggtctttggtggccgcacaggaaatgaggatattatttccagattgcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtggtaagaaacacgctgctgaggcacaaatgcggagggccgctcttttcagaggcatcttgcaaatggttaagaacgagccctccttgaggttccttgctaagtaagtttataagctccattttagttgggacagattaagcacaaacttgtttaaagcaataagataatttactggctcactggtcaaccccaggaccaatgggcctatcatggggactgcctctctctgcaccacacccaccctcctgcaagaggtcgacccccccatcctctcccagctgctgacaggtacctgggtatcctcagctcaggctgttcgccccacactatccccacaggcaggcctcccagggtacacgtcccgacccccaggggtgtccccagcactgataataggcagagatgtccagagttgcctgagccacttcttggtgttgcagacctcaggctggggcggctcctcctccgtgtggccccggatcagcacaccaggctgctgcctttcgctttttacagggtacctccacccacagggctggtcagggctgggcagtgtttcccagacccccatctcagcacctctgggtcccgccagatgggaagggttgtctgtgcctctgctccacagatgagcagtatcccttggcatcacctgctacctttccagcagtctgtagccatttgtcactatgtctttacctctagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcagggcaaccccgtggaactgataacaaaagctcgtctttttctgctgcagttaatacctcggtgcccgaaaaagagcttctcacacgtggcagaggtaacgtcaagatgcccaccttgggccacgtgggggacatgagaattgacagctgcctgggccatgtgcctgcctggctggcaatacaactcgactatttctgccagagcccctcccctgtggtctgaggcctagtgggcggcatgggctgaggacctgctcctctctcacagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgagggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttccttaaccacagattcttgtcttttttttttttgagatggagtttcgctctgttacccaggctgcagtgcggtggcgtgatctcagctcactgcaacctgcgcctcccgggctcaagcgattcttgtgcctcagcctgccaagtagctgggattacaggcgccccccaccacgcccagctgatttttgtatttttagtagagacagggtttacaccatattggccaggctggtcttgaattcctgaccttgtgatctgcctgcctcggtctcccaaagtgctgggattacatgtgtgagccactgcatccggcctgtgggcttatcttttaatgtcttatttgaggacgtggtgcagcagccttggtgtgggtgctcgaagtccctggcctcctacctgagcctcttctgtccagaggcccagtat

SEQ ID NO: 368767 - DNA, 6054 bp, Homo sapiens
gggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcgcggttgatgtactgcagagaatgctgatttttgcacttgacgctttggctgctggagtacaggaggagtcctccactcacaagatcgtgaggtgctggttcggagtgttcagtggacacacgcttggcagtgtaatttccacagatcctctgaagaggttcttcagtcataccctgactcagatactcactcacagccctgtgctgaaagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggcattcgagagctgccagctggacagcatggtcactgcgttcctggttgtgcgccaggcagcactggagggcccctctgcgttcctgtcatatgcagactggttcaaggcctcctttgggagcacacgaggctaccatggctgcagcaagaaggccctggtcttcctgtttacgttcttgtcagaactcgtgccttttgagtctccccggtacctgcaggtgcacattctccacccacccctggttcccagcaagtaccgctccctcctcacagactacatctcattggccaagacacggctggccgacctcaaggtttctatagaaaacatgggactctacgaggatttgtcatcagctggggacattactgagccccacagccaagctcttcaggatgttgaaaaggccatcatggtgtttgagcatacggggaacatcccagtcaccgtcatggaggccagcatattcaggaggccttactacgtgtcccacttcctccccgccctgctcacacctcgagtgctccccaaagtccctgactcccgtgtggcgtttatagagtctctgaagagagcagataaaatccccccatctctgtactccacctactgccaggcctgctctgctgctgaagagaagccagaagatgcagccctgggagtgagggcagaacccaactctgctgaggagcccctgggacagctcacagctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacatggctgtggacctcctgctgacgtctttctgtcagaacctgatggctgcctccagtgtcgctcccccggagaggcagggtccctgggctgccctcttcgtgaggaccatgtgtggacgtgtgctccctgcagtgctcacccggctctgccagctgctccgtcaccagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaaattttgtacagcagcaatttcttactctctctgcaagttttcttcccagtcacgagatactttgtgcagctgcttatctccaggccttattaaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaagctcaaggagttatgaccactcagaaaattctgatttggtctttggtggccgcacaggaaatgaggatattatttccagattgcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtgacctcaggctggggcggctcctcctccgtgtggccccggatcagcacaccaggctgctgcctttcgctttttacagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcagggcaaccccgtggaactgataacaaaagctcgtctttttctgctgcagttaatacctcggtgcccgaaaaagagcttctcacacgtggcagaggtaacgtcaagatgcccaccttgggccacgtgggggacatgagaattgacagctgcctgggccatgtgcctgcctggctggcaatacaactcgactatttctgccagagcccctcccctgtggtctgaggcctagtgggcggcatgggctgaggacctgctcctctctcacagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgagggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttccttaaccacagattcttgtcttttttttttttgagatggagtttcgctctgttacccaggctgcagtgcggtggcgtgatctcagctcactgcaacctgcgcctcccgggctcaagcgattcttgtgcctcagcctgccaagtagctgggattacaggcgccccccaccacgcccagctgatttttgtatttttagtagagacagggtttacaccatattggccaggctggtcttgaattcctgaccttgtgatctgcctgcctcggtctcccaaagtgctgggattacatgtgtgagccactgcatccggcctgtgggcttatcttttaatgtcttatttgaggacgtggtgcagcagccttggtgtgggtgctcgaagtccctggcctcctacctgagcctcttctgtccagaggcccagtat

SEQ ID NO: 368768 - DNA, 5946 bp, Homo sapiens
gggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcgcggttgatgtactgcagagaatgctgatttttgcacttgacgctttggctgctggagtacaggaggagtcctccactcacaagatcgtgaggtgctggttcggagtgttcagtggacacacgcttggcagtgtaatttccacagatcctctgaagaggttcttcagtcataccctgactcagatactcactcacagccctgtgctgaaagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggcattcgagagctgccagctggacagcatggtcactgcgttcctggttgtgcgccaggcagcactggagggcccctctgcgttcctgtcatatgcagactggttcaaggcctcctttgggagcacacgaggctaccatggctgcagcaagaaggccctggtcttcctgtttacgttcttgtcagaactcgtgccttttgagtctccccggtacctgcaggtgcacattctccacccacccctggttcccagcaagtaccgctccctcctcacagactacatctcattggccaagacacggctggccgacctcaaggtttctatagaaaacatgggactctacgaggatttgtcatcagctggggacattactgagccccacagccaagctcttcaggatgttgaaaaggccatcatggtgtttgagcatacggggaacatcccagtcaccgtcatggaggccagcatattcaggaggccttactacgtgtcccacttcctccccgccctgctcacacctcgagtgctccccaaagtccctgactcccgtgtggcgtttatagagtctctgaagagagcagataaaatccccccatctctgtactccacctactgccaggcctgctctgctgctgaagagaagccagaagatgcagccctgggagtgagggcagaacccaactctgctgaggagcccctgggacagctcacagctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacatggctgtggacctcctgctgacgtctttctgtcagaacctgatggctgcctccagtgtcgctcccccggagaggcagggtccctgggctgccctcttcgtgaggaccatgtgtggacgtgtgctccctgcagtgctcacccggctctgccagctgctccgtcaccagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaaattttgtacagcagcaatttcttactctctctgcaagttttcttcccagtcacgagatactttgtgcagctgcttatctccaggccttattaaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaagctcaaggagttatgaccactcagaaaattctgatttggtctttggtggccgcacaggaaatgaggatattatttccagattgcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtgacctcaggctggggcggctcctcctccgtgtggccccggatcagcacaccaggctgctgcctttcgctttttacagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcaggtgcaagggccagtcccacctccaggggagctccccccagccggaggctccttctgccaaagaatgttccggcacagcatgcagactatgggggacacaccagccctgtttctttaatacctcggtgcccgaaaaagagcttctcacacgtggcagagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgagggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttccttaaccacagattcttgtcttttttttttttgagatggagtttcgctctgttacccaggctgcagtgcggtggcgtgatctcagctcactgcaacctgcgcctcccgggctcaagcgattcttgtgcctcagcctgccaagtagctgggattacaggcgccccccaccacgcccagctgatttttgtatttttagtagagacagggtttacaccatattggccaggctggtcttgaattcctgaccttgtgatctgcctgcctcggtctcccaaagtgctgggattacatgtgtgagccactgcatccggcctgtgggcttatcttttaatgtcttatttgaggacgtggtgcagcagccttggtgtgggtgctcgaagtccctggcctcctacctgagcctcttctgtccagaggcccagtat

SEQ ID NO: 368769 - DNA, 2275 bp, Homo sapiens
ttaggcgctaggtacgaggctgggtgttggaagctacaagaaggcggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtgacctcaggctggggcggctcctcctccgtgtggccccggatcagcacaccaggctgctgcctttcgctttttacagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcagggcaaccccgtggaactgataacaaaagctcgtctttttctgctgcagttaatacctcggtgcccgaaaaagagcttctcacacgtggcagagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgagggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttccttaaccacagattcttgtcttttttttttttgagatggagtttcgctctgttacccaggctgcagtgcggtggcgtgatctcagctcactgcaacctgcgcctcccgggctcaagcgattcttgtgcctcagcctgccaagtagctgggattacaggcgccccccaccacgcccagctgatttttgtatttttagtagagacagggtttacaccatattggccaggctggtcttgaattcctgaccttgtgatctgcctgcctcggtctcccaaagtgctgggattacatgtgtgagccactgcatccggcctgtgggcttatcttttaatgtcttatttgaggacgtggtgcagcagccttggtgtgggtgctcgaagtccctggcctcctacctgagcctcttctgtccagaggcccagtat

SEQ ID NO: 368770 - DNA, 2231 bp, Homo sapiens
cgaggatcgatcagacctgtagaaatctccatcgtacacaaggtcataaccaccaccgattacacctggaggtccaggagggccagggggacccagggggactgcctctctctgcaccacacccaccctcctgcaagaggtcgacccccccatcctctcccagctgctgacaggtacctgggtatcctcagctcaggctgttcgccccacactatccccacaggcaggcctcccagggtacacgtcccgacccccaggggtgtccccagcactgataataggcagagatgtccagagttgcctgagccacttcttggtgttgcagacctcaggctggggcggctcctcctccgtgtggccccggatcagcacaccaggctgctgcctttcgctttttacagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcagggcaaccccgtggaactgataacaaaagctcgtctttttctgctgcagttaatacctcggtgcccgaaaaagagcttctcacacgtggcagagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgagggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttccttaaccacagattcttgtcttttttttttttgagatggagtttcgctctgttacccaggctgcagtgcggtggcgtgatctcagctcactgcaacctgcgcctcccgggctcaagcgattcttgtgcctcagcctgccaagtagctgggattacaggcgccccccaccacgcccagctgatttttgtatttttagtagagacagggtttacaccatattggccaggctggtcttgaattcctgaccttgtgatctgcctgcctcggtctcccaaagtgctgggattacatgtgtgagccactgcatccggcctgtgggcttatcttttaatgtcttatttgaggacgtggtgcagcagccttggtgtgggtgctcgaagtccctggcctcctacctgagcctcttctgtccagaggcccagtat

SEQ ID NO: 368771 - DNA, 3939 bp, Homo sapiens
gggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcgcggttgatgtactgcagagaatgctgatttttgcacttgacgctttggctgctggagtacaggaggagtcctccactcacaagatcgtgaggtgctggttcggagtgttcagtggacacacgcttggcagtgtaatttccacagatcctctgaagaggttcttcagtcataccctgactcagatactcactcacagccctgtgctgaaagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggcattcgagagctgccagctggacagcatggtcactgcgttcctggttgtgcgccaggcagcactggagggcccctctgcgttcctgtcatatgcagactggttcaaggcctcctttgggagcacacgaggctaccatggctgcagcaagaaggccctggtcttcctgtttacgttcttgtcagaactcgtgccttttgagtctccccggtacctgcaggtgcacattctccacccacccctggttcccagcaagtaccgctccctcctcacagactacatctcattggccaagacacggctggccgacctcaaggtttctatagaaaacatgggactctacgaggatttgtcatcagctggggacattactgagccccacagccaagctcttcaggatgttgaaaaggccatcatggtgtttgagcatacggggaacatcccagtcaccgtcatggaggccagcatattcaggaggccttactacgtgtcccacttcctccccgccctgctcacacctcgagtgctccccaaagtccctgactcccgtgtggcgtttatagagtctctgaagagagcagataaaatccccccatctctgtactccacctactgccaggcctgctctgctgctgaagagaagccagaagatgcagccctgggagtgagggcagaacccaactctgctgaggagcccctgggacagctcacagctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacatggctgtggacctcctgctgacgtctttctgtcagaacctgatggctgcctccagtgtcgctcccccggagaggcagggtccctgggctgccctcttcgtgaggaccatgtgtggacgtgtgctccctgcagtgctcacccggctctgccagctgctccgtcaccagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaaattttgtacagcagcaatttcttactctctctgcaagttttcttcccagtcacgagatactttgtgcagctgcttatctccaggccttattaaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaagctcaaggagttatgaccactcagaaaattctgatttggtctttggtggccgcacaggaaatgaggatattatttccagattgcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgagtacgtgtgggtggtgagatggggtgtgcccgcccagatgcacttcgggacctgctcaaggtcatctcctaaacaccctggcttgcttgagagaagcggtgtgggcagcctctcgtgtgagcagggagaaaagaaccgagttctcgtggtggtgggcgcctgtaatcccaactactggggaggccgaggcaggagaatcagttgaacccaggaggtggagtttccagtgagccgagatcactccaacggccaatagagcaagactctgtcca

SEQ ID NO: 368772 - DNA, 1759 bp, Homo sapiens
gggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcgcggttgatgtactgcagagaatgctgatttttgcacttgacgctttggctgctggagtacaggaggagtcctccactcacaagatcgtgaggtgctggttcggagtgttcagtggacacacgcttggcagtgtaatttccacagatcctctgaagaggttcttcagtcataccctgactcagatactcactcacagccctgtgctgaaagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggcattcgagagctgccagctggacagcatggtcactgcgttcctggttgtgcgccaggcagcactggagggcccctctgcgttcctgtcatatgcagactggttcaaggtaagtgacctgccaatcggctacctaatacctgatcttcccagaaggcctgggagtggggaccatgctgtccccacctgattctctgtcatgtgagtgagcaaccttgccgtcagctttgccgagtggccttggcagatcttcctctgcgtgtgccgaggagcctgggttctccctgtcggggcctcggcggatcttcctctgcatgttccgaggagcctgggttctccctgtcggggcctcagctccttcccctggtttccgtctcacttagttgacggagcctcctgctgtcttttataagaaaattagcgaaatcaagcctggacaccatggtgaaacctcatctccaccaaaaa

SEQ ID NO: 368773 - DNA, 1807 bp, Homo sapiens
gggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcgcggttgatgtactgcagagaatgctgatttttgcacttgacgctttggctgctggagtacaggaggagtcctccactcacaagatcgtgaggtgctgagcttcagcagcccgctcctgagcacacttcctctgccagttacgataacgtgcgtgaggaggaggcgaccatgggaaagcccggggaacgctctggtcagccttttcctgtgaggatgaggtcggaaggtgcgcccactgcagtatcctgttccgcctctggaagtcctgcaccaatgtttgtcccactcactgtgacctcctcctgtgtggagtctccccttgctcctccttccctgggtgtggttcaggctctagagctggccctgcctctcagccccccacatttctagaacacactgtagctgtgcctctacagactcccgctgcctggcctccacagatcctgctcagattcaccagtaggcaaagcttggccctatttgctttttctctccatggctctgtggagatgtgcggagacccttacaggtcgggaggcggaagctgaggagtgggggctgggtggaaggtggacatcggggtttggtggaaatggggctctggggtttgcttccctctagtgtgggcaggggaccttgaagtgaagtcttgagaaaccagtagaatttgccactgtttccaggccttgtcaaccttttcattctttattttgctcctcatttcccatccctcacagtaactgtttaactgctcaattaaatgtgttgtaccgttcggtacttttactgaaaaaaaaaaaaaaaaaactcgagttttttttttttttttttttactgatatctctttaatactttcatcattcaagtttgttcagaacattacaagaggcatgaaagaaaaaataattccatttttaaaactctgtccaaagtataacatatgaccatgccattatctcttaggcgcttc

SEQ ID NO: 368774 - DNA, 333 bp, Homo sapiens
gctgccccgggaactgcagaagctacaagaaggccggcagtttgccagcgagtacgtgtgggtggtgagatggggtgtgcccgcccagatgcacttcgggacctgctcaaggtcatctcctaaacaccctggcttgcttgagagaagcggtgtgggcagcctctcgtgtgagcagggagaaaagaaccgagttctcgtggtggtgggcgcctgtaatcccaactactggggaggccgaggcaggagaatcagttgaacccaggaggtggagtttccagtgagccgagatcactccaacggccaatagagcaagactctgtccagaaaaaaaac

SEQ ID NO: 368775 - DNA, 1037 bp, Homo sapiens
gcggagctgggtgcgagcgccctaccgctttcgctttcccttcgcggtgcccactccactccttgtgcggcgctaggccccccgtcccggtcatggccatgctcagggtccagcccgaggcccaagccaaggtggatgtgtttcgtgaagacctctgtaccaagacagagaacctgctcgggagctatttccccaagaagatttctgagctggatgcatttttaaaggagccagctctcaatgaagccaacttgagcaatctgaaggccccattggacatcccagtgcctgatccagtcaaggagaaagagaaagaggagcggaagaaacagcaggagaaggaagacaaggatgaaaagaagaagggggaggatgaagacaaaggtcctccctgtggcccagtgaactgcaatgaaaagatcgtggtccttctgcagcgcttgaagcctgagatcaaggatgtcattgagcagctcaacctggtcaccacctggttgcagctgcagatacctcggattgaggatggtaacaattttggagtggctgtccaggagaaggtgtttgagctgatgaccagcctccacaccaagctagaaggcttccacactcaaatctctaagtatttctctgagcgtggtgatgcagtgactaaagcagccaagcagccccatgtgggtgattatcggcagctggtgcacgagctggatgaggcagagtaccgggacatccggctgatggtcatggagatccgcaatgcttatgctgtgttatatgacatcatcctgaagaacttcgagaagctcaagaagcccaggggagaaacaaagggaatgatctattgagagccctctctcccattctgtgatgagtacagcagagaccttcctgctttttactggggactccagattttccccaaacttgcttctgttgagatttttccctcaccttgcctctcaggcacaataaatatagttataccactgccatttagtcagcccaagtcctctttattggaaccgggccccgctggccct

SEQ ID NO: 368776 - DNA, 757 bp, Homo sapiens
gcggagctgggtgcgagcgccctaccgctttcgctttcccttcgcggtgcccactccactccttgtgcggcgctaggccccccgtcccggtcatggccatgctcagggtccagcccgaggcccaagccaaggtggatgtgtttcgtgaagacctctgtaccaagacagagaacctgctcgggagctatttccccaagaagatttctgagctggatgcatttttaaaggagccagctctcaatgaagccaacttgagcaatctgaaggccccattggacatcccagtgcctgatccagtcaaggagaaagagaaagaggagcggaagaaacagcaggagaaggaagacaaggatgaaaagaagaagggggaggatgaagacaaaggtcctccctgtggcccagtgaactgcaatgaaaagatcgtggtccttctgcagcgcttgaagcctgagatcaaggatgtcattgagcagctcaacctggtcaccacctggttgcagctgcagatacctcggattgaggatggtaacaattttggagtggctgtccagcagaagctgtttcgagttgtgaccagacttcacaccaagctagacgggttacacatcttttctaatcctttgtctatgcggtgtgatggcactgactcatggaaccatgcctgtcccttgatcgatgctatttggcaggcttcttctcaggctctactacgtattactaccagccttccgccttttcttcctctctggtccttccc

SEQ ID NO: 368777 - DNA, 663 bp, Homo sapiens
  misc_feature (573)..(573): n is a, c, g, or t
  misc_feature (575)..(575): n is a, c, g, or t
  misc_feature (577)..(578): n is a, c, g, or t
  misc_feature (580)..(580): n is a, c, g, or t
  misc_feature (586)..(586): n is a, c, g, or t
  misc_feature (591)..(592): n is a, c, g, or t
  misc_feature (598)..(598): n is a, c, g, or t
  misc_feature (602)..(602): n is a, c, g, or t
cagaaaataaactccttgagctttgctaggccccccgtacaaggacatggccatgctaagggtccaagcccgaggcccaagccaaggtgagatgtgtttcgagaagacctatgtaccaagacagagaacctgctcgggagctatttccccaagaagatttctgagctggatgcatttttaaaggagccagctctcaatgaagccaacttgagcaatctgaaggccccattggacatcccagtgcctgatccagtcaaggagaaagagaaagaggagcggaagaaacagcaggagaaggaagacaaggatgaaaagaagaagggggaggatgaagacaaaggtcctccctgtggcccagtgaactgcaatgaaaagatcggtcaccacctggttgcagctgcagatacctcggattgaggatggtaacaattttggagtggctgtccaggagaaggtgtttgagctgatgaccagcctccacaccaagctagaaggcttccacactcaaatctctaagtatttctctgagcgtggtgatgcagtgactaaagcagccaagcagccccatgtggntnannancggcanctggnncacganctgnatgacgcagcataccgcggacatccgactgaatagctacaaggaaagcacgcaagccgacg

SEQ ID NO: 368778 - DNA, 1074 bp, Homo sapiens
gcggagctgggtgcgagcgccctaccgctttcgctttcccttcgcggtgcccactccactccttgtgcggcgctaggccccccgtcccggtcatggccatgctcagggtccagcccgaggcccaagccaaggtcaggccctacataaccctaagggaactgtcctcaaatgaactggccttaaagccaagtttctgaagggatgcgtgtgccccacaggtggatgtgtttcgtgaagacctctgtaccaagacagagaacctgctcgggagctatttccccaagaagatttctgagctggatgcatttttaaaggagccagctctcaatgaagccaacttgagcaatctgaaggccccattggacatcccagtgcctgatccagtcaaggagaaagagaaagaggagcggaagaaacagcaggagaaggaagacaaggatgaaaagaagaagggggaggatgaagacaaaggtcctccctgtggcccagtgaactgcaatgaaaagatcgtggtccttctgcagcgcttgaagcctgagatcaaggatgtcattgagcagctcaacctggtcaccacctggttgcagctgcagatacctcggattgaggatggtaacaattttggagtggctgtccaggagaaggtgtttgagctgatgaccagcctccacaccaagctagaaggcttccacactcaaatctctaagtatttctctgagcgtggtgatgcagtgactaaagcagccaagcagccccatgtgggtgattatcggcagctggtgcacgagctggatgaggcagagtaccgggacatccggctgatggtcatggagatccgcaatgcttatgctgtgttatatgacatcatcctgaagaacttcgagaagctcaagaagcccaggggagaaacaaagggaatgatctattgagagccctctctcccattctgtgatgagtacagcagagaccttcctgctttttactggggactccagattttccccaaacttgcttctgttgagatttttccctcaccttgcctctcaggcacaataaatatagttataccactgc

SEQ ID NO: 368779 - DNA, 1162 bp, Homo sapiens
gcggagctgggtgcgagcgccctaccgctttcgctttcccttcgcggtgcccactccactccttgtgcggcgctaggccccccgtcccggtcatggccatgctcagggtccagcccgaggcccaagccaaggtggatgtgtttcgtgaagacctctgtaccaagacagagaacctgctcgggagctatttccccaagaagatttctgagctggatgcatttttaaaggagccagctctcaatgaagccaacttgagcaatctgaaggccccattggacatcccagtgcctgatccagtcaaggagaaagagaaagaggagcggaagaaacagcaggagaaggaagacaaggatgaaaagaagaagggggaggatgaagacaaaggtcctccctgtggcccagtgaactgcaatgaaaagatcgtggtccttctgcagcgcttgaagcctgagatcaaggatgtcattgagcagctcaacctggtcaccacctggttgcagctgcagatacctcggattgaggatggtaacaattttggagtggctgtccaggagaaggtgtttgagctgatgaccagcctccacaccaagctagaaggcttccacactcaaatctctaagtatttctctgagcgtggtgatgcagtgactaaagcagccaagcagccccatgtgggtgattatcggcagctggtgcacgagctggatgaggcagagtaccgggacatccggctgatggtcatggagatccgcaatgcttatgtgaggaggcaagggcagggcaggggtgggcagaggcagctttcccaggccacccactccctgaccctgcaggctaggggttaagggtgacaaagctcagcttctccacaaggctagaaatggggcacagagccactggaggcctctgactgacctctactccctggccctgtaggctgtgttatatgacatcatcctgaagaacttcgagaagctcaagaagcccaggggagaaacaaagggaatgatctattgagagccctctctcccattctgtgatgagtacagcagagaccttcctgctttttactggggactccagattttccccaaacttgcttctgttgagatttttccctcaccttgcctctcaggcacaataaatatagttataccactgc

SEQ ID NO: 368780 - DNA, 827 bp, Homo sapiens
ctacttttagctctcctggaagagataacttcgttctgttttgttaaataagtaactccatggttgttctcttttccaagatgcccgatgtttatggttttctacgaagtcagtgcttacttagctcactatcagcgctgctgttgtctgctgcagctgcagcagacaacagcaggagaaggaagacaaggatgaaaagaagaagggggaggatgaagacaaaggtcctccctgtggcccagtgaactgcaatgaaaagatcgtggtccttctgcagcgcttgaagcctgagatcaaggatgtcattgagcagctcaacctggtcaccacctggttgcagctgcagatacctcggattgaggatggtaacaattttggagtggctgtccaggagaaggtgtttgagctgatgaccagcctccacaccaagctagaaggcttccacactcaaatctctaagtatttctctgagcgtggtgatgcagtgactaaagcagccaagcagccccatgtgggtgattatcggcagctggtgcacgagctggatgaggcagagtaccgggacatccggctgatggtcatggagatccgcaatgcttatgctgtgttatatgacatcatcctgaagaacttcgagaagctcaagaagcccaggggagaaacaaagggaatgatctattgagagccctctctcccattctgtgatgagtacagcagagaccttcctgctttttactggggactccagattttccccaaacttgcttctgttgagatttttccctcaccttgcctctcaggcacaataaatatagttataccactgc

SEQ ID NO: 368781 - DNA, 1065 bp, Homo sapiens
gcggagctgggtgcgagcgccctaccgctttcgctttcccttcgcggtgcccactccactccttgtgcggcgctaggccccccgtcccggtcatggccatgctcagggtccagcccgaggcccaagccaaggtggatgtgtttcgtgaagacctctgtaccaagacagagaacctgctcgggagctatttccccaagaagatttctgagctggatgcatttttaaaggagccagctctcaatgaagccaacttgagcaatctgaaggccccattggacatcccagtgcctgatccagtcaaggagaaagagaaagaggagcggaagaaacagcaggagaaggaagacaaggatgaaaagaagaagggggaggatgaagacaaaggtcctccctgtggcccagtgaactgcaatgaaaagatcgtggtccttctgcagcgcttgaagcctgagatcaaggatgtcattgagcagctcaacctggtcaccacctggttgcagctgcagatacctcggattgaggatggtaacaattttggagtggctgtccaggtgagagcgctgccccacttccctgctcttttctagtccatgcttccttccactttcccccttgctttttttccctaggagaaggtgtttgagctgatgaccagcctccacaccaagctagaaggcttccacactcaaatctctaagtatttctctgagcgtggtgatgcagtgactaaagcagccaagcagccccatgtgggtgattatcggcagctggtgcacgagctggatgaggcagagtaccgggacatccggctgatggtcatggagatccgcaatgcttatgctgtgttatatgacatcatcctgaagaacttcgagaagctcaagaagcccaggggagaaacaaagggaatgatctattgagagccctctctcccattctgtgatgagtacagcagagaccttcctgctttttactggggactccagattttccccaaacttgcttctgttgagatttttccctcaccttgcctctcaggcacaataaatatagttataccactgc

SEQ ID NO: 368782 - DNA, 766 bp, Homo sapiens
  misc_feature (676)..(676): n is a, c, g, or t
  misc_feature (678)..(678): n is a, c, g, or t
  misc_feature (680)..(681): n is a, c, g, or t
  misc_feature (683)..(683): n is a, c, g, or t
  misc_feature (689)..(689): n is a, c, g, or t
  misc_feature (694)..(695): n is a, c, g, or t
  misc_feature (701)..(701): n is a, c, g, or t
  misc_feature (705)..(705): n is a, c, g, or t
gcggagctgggtgcgagcgccctaccgctttcgctttcccttcgcggtgcccactccactccttgtgcggcgctaggccccccgtcccggtcatggccatgctcagggtccagcccgaggcccaagccaaggtggatgtgtttcgtgaagacctctgtaccaagacagagaacctgctcgggagctatttccccaagaagatttctgagctggatgcatttttaaaggagccagctctcaatgaagccaacttgagcaatctgaaggccccattggacatcccagtgcctgatccagtcaaggagaaagagaaagaggagcggaagaaacagcaggagaaggaagacaaggatgaaaagaagaagggggaggatgaagacaaaggtcctccctgtggcccagtgaactgcaatgaaaagatcgtggtccttctgcagcgcttgaagcctgagatcaaggatgtcattgagcagctcaacctggtcaccacctggttgcagctgcagatacctcggattgaggatggtaacaattttggagtggctgtccaggagaaggtgtttgagctgatgaccagcctccacaccaagctagaaggcttccacactcaaatctctaagtatttctctgagcgtggtgatgcagtgactaaagcagccaagcagccccatgtggntnannancggcanctggnncacganctgnatgacgcagcataccgcggacatccgactgaatagctacaaggaaagcacgcaagccgacg

SEQ ID NO: 368783 - DNA, 661 bp, Homo sapiens
gcggagctgggtgcgagcgccctaccgctttcgctttcccttcgcggtgcccactccactccttgtgcggcgctaggccccccgtcccggtcatggccatgctcagggtccagcccgaggcccaagccaaggtggatgtgtttcgtgaagacctctgtaccaagacagagaacctgctcgggagctatttccccaagaagatttctgagctggatgcatttttaaaggagccagctctcaatgaagccaacttgagcaatctgaaggccccattggacatcccagtgcctgatccagtcaaggagaaagagaaagaggagcggaagaaacagcaggagaaggaagacaaggatgaaaagaagaagggggaggatgaagacaaaggtcctccctgtggcccagtgaactgcaatgaaaagatcgtggtccttctgcagcgcttgaagcctgagatcaaggatgtcattgagcagctcaacctggtcaccacctggttgcagctgcagatacctcggattgaggatggtaacaattttggagtggctgtccaggagaaggtgtttgagctgatgaccagcctccacaccaagctagaaggcttccacactcaaatctctaagcggatcagctagcggatcacttaagcggatcagcgggtcct

SEQ ID NO: 368784 - DNA, 707 bp, Homo sapiens
  misc_feature (659)..(659): n is a, c, g, or t
gcggagctgggtgcgagcgccctaccgctttcgctttcccttcgcggtgcccactccactccttgtgcggcgctaggccccccgtcccggtcatggccatgctcagggtccagcccgaggcccaagccaaggtggatgtgtttcgtgaagacctctgtaccaagacagagaacctgctcgggagctatttccccaagaagatttctgagctggatgcatttttaaaggagccagctctcaatgaagccaacttgagcaatctgaaggccccattggacatcccagtgcctgatccagtcaaggagaaagagaaagaggagcggaagaaacagcaggagaaggaagacaaggatgaaaagaagaagggggaggatgaagacaaaggtcctccctgtggcccagtgaactgcaatgaaaagatcgtggtccttctgcagcgcttgaagcctgagatcaaggatgtcattgagcagctcaacctggtcaccacctggttgcagctgcagatacctcggattgaggatggtaacaattttggagtggctgtccaggagaaggtgtttgagctgatgaccagcctccacaccaagctagaaggcttccacactcaaatctctaatatttctctgagcgtggtgatgcagtgactgattaggcanaataccggacaatccgctgatgggcattgagatccccatgcttattct

SEQ ID NO: 368785 - DNA, 633 bp, Homo sapiens
gctaggccccccgtcccggtcatggccatgctcagggtccagcccgaggcccaagccaaggtgagcgccgcggggtctagaaagggcccactggggaggcgtggctggagcggccgggggcatccccgacccgccccccaggctcccacgcgagtcgggggcagtcggccgagctggcgcgcccggagcacctgcgccccggggagggcggcgactgctgcctgcggggagaggcgaggcggccgtggttctgcggggtgaggtgaagcggagagctggcgtggaggggaactccgctggcctggggccggggccacacacagactgggtgcgggactgccccagctaccttctggcctttccctcagggagggtcccggggcccaccccatccctgtcctacttgcagaggactctcagcacccctcctcacacctgccaggcgaccccagagatctgttctcacgtgaacactggcccttcaccgccaggaatgttctcatcccccatatccagccccagggatacccactccactttccgtagatccaggtctgcagagatccaccttctccaccaccccaacccaccctacaggcatccatctcgctttcttcaggtctggccttagag

SEQ ID NO: 368786 - DNA, 335 bp, Homo sapiens
cctggttgcagctgcagatacctcggattgaggatggtaacaattttggagtggctgtccaggtgagagcgctgccccacttccctgctcttttctagtccatgcttccttccactttcccccttgctttttttccctaggagaaggtgtttgagctgatgaccagcctccacaccaagctagaaggcttccacactcaaatctctaagtgagtgaccacccatgtgcacactgtttttgttttgggagacctccttcttctactccatacacacttctccttccacaggtatttctctgagcgtggtgatgcagtgactaaagcagccaagcag

SEQ ID NO: 368787 - DNA, 161 bp, Homo sapiens
gtaggtgaggcccaggtcagggtgcatgggggaaggacacatgtaaggtcaggcctgacccgagcttcccacagggtgattatcggcagctggtgcacgagctggatgaggcagagtaccgggacatccggctgatggtcatggagatccgcaatgcttat

SEQ ID NO: 368788 - DNA, 987 bp, Homo sapiens
gcggagctgggtgcgagcgccctaccgctttcgctttcccttcgcggtgcccactccactccttgtgcggcgctaggccccccgtcccggtcatggccatgctcagggtccagcccgaggcccaagccaaggtggatgtgtttcgtgaagacctctgtaccaagacagagaacctgctcgggagctatttccccaagaagatttctgagctggatgcatttttaaaggagccagctctcaatgaagccaacttgagcaatctgaaggccccattggacatcccagtgcctgatccagtcaaggagaaagagaaagaggagcggaagaaacagcaggagaaggaagacaaggatgaaaagaagaagggggaggatgaagacaaaggtcctccctgtggcccagtgaactgcaatgaaaagatcgtggtccttctgcagcgcttgaagcctgagatcaaggatgtcattgagcagctcaacctggtcaccacctggttgcagctgcagatacctcggattgaggatggtaacaattttggagtggctgtccaggagaaggtgtttgagctgatgaccagcctccacaccaagctagaaggcttccacactcaaatctctaagtatttctctgagcgtggtgatgcagtgactaaagcagccaagcagccccatgtgggtgattatcggcagctggtgcacgagctggatgaggcagagtaccgggacatccggctgatggtcatggagatccgcaatgcttatgctgtgttatatgacatcatcctgaagaacttcgagaagctcaagaagcccaggggagaaacaaagggaatgatctattgagagccctctctcccattctgtgatgagtacagcagagaccttcctgctttttactggggactccagattttccccaaacttgcttctgttgagatttttccctcaccttgcctctcaggcacaataaatatagttataccactgc

SEQ ID NO: 368789 - DNA, 497 bp, Homo sapiens
gttaaaggcatatcgtcgacccacgcgctccgatggtaacaattttggagtggctgtccaggagaaggtgtttgagctgatgaccagcctccacaccaagctagaaggcttccacactcaaatctctaagtatttctctgagcgtggtgatgcagtgactaaagcagccaagcagccccatgtgggtgattatcggcagctggtgcacgagctggatgaggcagagtaccgggacatccggctgatggtcatggagatccgcaatgcttatgctgtgttatatgacatcatcctgaagaacttcgagaagctcaagaagcccaggggagaaacaaagggaatgatctattgagagccctctctcccattctgtgatgagtacagcagagaccttcctgctttttactggggactccagattttccccaaacttgcttctgttgagatttttccctcaccttgcctctcaggcacaataaatatagttataccactgc

SEQ ID NO: 368790 - DNA, 389 bp, Homo sapiens
gaacgagccggtaccagcaggctgggcccagattaagatgtcatggagcagctcaacctggtcaccacctggttgcagctgcagatacctcggattgaggatggtaacaattttggagtggctgtccaggagaaggtgtttgagctgatgaccagcctccacaccaagctagaaggcttccacactcaaatctctaagtatttctctgagcgtggtgatgcagtgactaaagcagccaagcagccccatgtgggtgattatcggcagctggtgcacgagctggatgaggcagagtaccgggacatccggctgatggtcatggagatccgcaatgcttatgctgtgttatatgacatcttaatctgggcccagcctgctggtccggctca

SEQ ID NO: 368791 - DNA, 679 bp, Homo sapiens
  misc_feature (657)..(657): n is a, c, g, or t
gttaaaggcatatcgtcgacccacgcgctccgatggtaacaattttggagtggctgtccaggagaaggtgtttgagctgatgaccagcctccacaccaagctagaaggcttccacactcaaatctctaagtatttctctgagcgtggtgatgcagtgactaaagcagccaagcagccccatgtgggtgattatcggcagctggtgcacgagctggatgaggcagagtaccgggacatccggctgatggtcatggagatccgcaatgcttatgctgtgttatatgacatcatcctgaagaacttcgagaagctcaagaagcccaggggagaaacaaagggaatgatctattgagagccctctctcccattctgtgatgagtacagcagagaccttcctgctttttactggggactccagattttccccaaacttgcttctgttgagatttttccctcaccttgcctctcaggcacaataaatatagttataccactgcaaaaaaaaaaaaaaaaaaaaaaaaaaaaaaaaaaaaaaaaaaaaaccttgtggcccgcttggcccaagcggcttttagactggaccaggttaatgcatgcgcccgaatttcgagttactggccttggccctatggggagcggattaccattcttgcccgncgttttacaccgtcgggcttgg

SEQ ID NO: 368792 - DNA, 1299 bp, Homo sapiens
  misc_feature (998)..(998): n is a, c, g, or t
  misc_feature (1000)..(1001): n is a, c, g, or t
  misc_feature (1008)..(1008): n is a, c, g, or t
  misc_feature (1011)..(1011): n is a, c, g, or t
  misc_feature (1026)..(1026): n is a, c, g, or t
  misc_feature (1107)..(1108): n is a, c, g, or t
  misc_feature (1110)..(1111): n is a, c, g, or t
  misc_feature (1120)..(1120): n is a, c, g, or t
gcggagctgggtgcgagcgccctaccgctttcgctttcccttcgcggtgcccactccactccttgtgcggcgctaggccccccgtcccggtcatggccatgctcagggtccagcccgaggcccaagccaaggtggatgtgtttcgtgaagacctctgtaccaagacagagaacctgctcgggagctatttccccaagaagatttctgagctggatgcatttttaaaggagccagctctcaatgaagccaacttgagcaatctgaaggccccattggacatcccagtgcctgatccagtcaaggagaaagagaaagaggagcggaagaaacagcaggagaaggaagacaaggatgaaaagaagaagggggaggatgaagacaaaggtcctccctgtggcccagtgaactgcaatgaaaagatcgtggtccttctgcagcgcttgaagcctgagatcaaggatgtcattgagcagctcaacctggtcaccacctggttgcagctgcagatacctcggattgaggatggtaacaattttggagtggctgtccaggagaaggtgtttgagctgatgaccagcctccacaccaagctagaaggcttccacactcaaatctctaagtatttctctgagcgtggtgatgcagtgactaaagcagccaagcagccccatgtgggtgattatcggcagctggtgcacgagctggatgaggcagagtaccgggacatccggctgatggtcatggagatccgcaatgcttatgctgtgttatatgacatcatcctgaagaacttcgagaagctcaagaagcccaggggagaaacaaagggaatgatctattgagagccctctctcccattctgtgatgagtacagcagagaccttcctgctttttactggggactccagattttccccaaacttgcttctgttgagatttttccctcaccttgcctctcaggcacaataaatatagttataccactgcaaaaaaaaaanannaaaaaanaanaaaaaaaaaaaaaanaaaaaaaaaaaaaaaaaaaaaaaaaaaaaaaaaaaaaaaaaaaaaagaaaaaaacaaaaaaaaaataaggaaaaaaaaaannannaaaaggaancccactgcccataaatcacatacacggggccgggaaaacccaacggtaacacatttaaacccttgcgattggaaactcccttggttccctacctaaacacttttaggcccttccctatttccattttgcccgtttcgtaactttttagaaattgggccttccaacttgaccacttctca

SEQ ID NO: 368793 - DNA, 1259 bp, Homo sapiens
atctgaaggcccattggacatcccagtgcctgatccagtcaaggagaaagagaaagaggagcggaagaaacagcaggagaaggtctgcagagatccaccttctccaccaccccaacccaccctacaggcatccatctcgctttcttcaggtctggccttagagggatcccctccacccttccccaggtcaggccctacataaccctaagggaactgtcctcaaatgaactggccttaaagccaagtttctgaagggatgcgtgtgccccacaggtggatgtgtttcgtgaagacctctgtaccaaggtaagacatgccccatcagcgtggccccacccctgcccaactcctactgctcaaccctgcctcactacctaggacgggcatttgatgctgactcccatcctcctccacccctcaccttccaccagcacagacagagaacctgctcgggagctatttccccaagaagatttctgagctggatgcatttttaaaggagccagctctcaatgaagccaacttgagcaatctgaaggccccattggacatcccagtgcctgatccagtcaaggagaaagagaaagaggagcggaagaaacagcaggagaaggaagacaaggatgaaaagaagaagggggaggatgaagacaaaggtcctccctgtggcccagtgaactgcaatgaaaagatcgtggtccttctgcagcgcttgaagcctgagatcaaggatgtcattgagcagctcaacctggtcaccacctggttgcagctgcagatacctcggattgaggatggtaacaattttggagtggctgtccaggagaaggtgtttgagctgatgaccagcctccacaccaagctagaaggcttccacactcaaatctctaagtatttctctgagcgtggtgatgcagtgactaaagcagccaagcagccccatgtgggtgattatcggcagctggtgcacgagctggatgaggcagagtaccgggacatccggctgatggtcatggagatccgcaatgcttatgctgtgttatatgacatcatcctgaagaacttcgagaagctcaagaagcccaggggagaaacaaagggaatgatctattgagagccctctctcccattctgtgatgagtacagcagagaccttcctgctttttactggggactccagattttccccaaacttgcttctgttgagatttttccctcaccttgcctctcaggcacaataaatatagttataccactgc

SEQ ID NO: 368794 - DNA, 928 bp, Homo sapiens
gcggagctgggtgcgagcgccctaccgctttcgctttcccttcgcggtgcccactccactccttgtgcggcgctaggccccccgtcccggtcatggccatgctcagggtccagcccgaggcccaagccaaggtggatgtgtttcgtgaagacctctgtaccaagacagagaacctgctcgggagctatttccccaagaagatttctgagctggatgcatttttaaaggagccagctctcaatgaagccaacttgagcaatctgaaggccccattggacatcccagtgcctgatccagtcaaggagaaagagaaagaggagcggaagaaacagcaggagaaggaagacaaggatgaaaagaagaagggggaggatgaagacaaaggtcctccctgtggcccagtgaactgcaatgaaaagatcggtcaccacctggttgcagctgcagatacctcggattgaggatggtaacaattttggagtggctgtccaggagaaggtgtttgagctgatgaccagcctccacaccaagctagaaggcttccacactcaaatctctaagtatttctctgagcgtggtgatgcagtgactaaagcagccaagcagccccatgtgggtgattatcggcagctggtgcacgagctggatgaggcagagtaccgggacatccggctgatggtcatggagatccgcaatgcttatgctgtgttatatgacatcatcctgaagaacttcgagaagctcaagaagcccaggggagaaacaaagggaatgatctattgagagccctctctcccattctgtgatgagtacagcagagaccttcctgctttttactggggactccagattttccccaaacttgcttctgttgagatttttccctcaccttgcctctcaggcacaataaatatagttataccactgc

SEQ ID NO: 368795 - DNA, 681 bp, Homo sapiens
accaagactcatattcttttgccaggcatccctaggcccctcccattcttattgaatacaagccgtgatcttacatctcctcagcatgaaaacaggtgaactgcaatgaaaagatcgtggtccttctgcagcgcttgaagcctgagatcaaggatgtcattgagcagctcaacctggtcaccacctggttgcagctgcagatacctcggattgaggatggtaacaattttggagtggctgtccaggagaaggtgtttgagctgatgaccagcctccacaccaagctagaaggcttccacactcaaatctctaagtatttctctgagcgtggtgatgcagtgactaaagcagccaagcagccccatgtgggtgattatcggcagctggtgcacgagctggatgaggcagagtaccgggacatccggctgatggtcatggagatccgcaatgcttatgctgtgttatatgacatcatcctgaagaacttcgagaagctcaagaagcccaggggagaaacaaagggaatgatctattgagagccctctctcccattctgtgatgagtacagcagagaccttcctgctttttactggggactccagattttccccaaacttgcttctgttgagatttttccctcaccttgcctctcaggcacaataaatatagttataccactgc

SEQ ID NO: 368796 - DNA, 1310 bp, Homo sapiens
gcggagctgggtgcgagcgccctaccgctttcgctttcccttcgcggtgcccactccactccttgtgcggcgctaggccccccgtcccggtcatggccatgctcagggtccagcccgaggcccaagccaaggtggatgtgtttcgtgaagacctctgtaccaaggtaagacatgccccatcagcgtggccccacccctgcccaactcctactgctcaaccctgcctcactacctaggacgggcatttgatgctgactcccatcctcctccacccctcaccttccaccagcacagacagagaacctgctcgggagctatttccccaagaagatttctgagctggatgcatttttaaaggtaccgcggctgggcagggagctagggagtaaaggccaagagaagagtctggaggctgtgagagtgaggtgagaggaactccctcacctccagccctcctcccaccctacaccaggagccagctctcaatgaagccaacttgagcaatctgaaggccccattggacatcccagtgcctgatccagtcaaggagaaagagaaagaggagcggaagaaacagcaggagaaggaagacaaggatgaaaagaagaagggggaggatgaagacaaaggtcctccctgtggcccagtgaactgcaatgaaaagatcgtggtccttctgcagcgcttgaagcctgagatcaaggatgtcattgagcagctcaacctggtcaccacctggttgcagctgcagatacctcggattgaggatggtaacaattttggagtggctgtccaggtgagagcgctgccccacttccctgctcttttctagtccatgcttccttccactttcccccttgctttttttccctaggagaaggtgtttgagctgatgaccagcctccacaccaagctagaaggcttccacactcaaatctctaagtatttctctgagcgtggtgatgcagtgactaaagcagccaagcagccccatgtgggtgattatcggcagctggtgcacgagctggatgaggcagagtaccgggacatccggctgatggtcatggagatccgcaatgcttatgctgtgttatatgacatcatcctgaagaacttcgagaagctcaagaagcccaggggagaaacaaagggaatgatctattgagagccctctctcccattctgtgatgagtacagcagagaccttcctgctttttactggggactccagattttccccaaacttgcttctgttgagatttttccctcaccttgcctctcaggcacaataaatatagttataccactgc

SEQ ID NO: 368797 - DNA, 620 bp, Homo sapiens
cacagtggcatgtggagacaacagtgtgtcccagtgacttttctttaccccccagctgtcggcagtactcagtggaagggtgatatgacactgatactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagcagagcatcgtcattcttcaggattgccctgctggccctacctcacagctgaaactttaaaaaacaggatgggccaccagccacctcctccaactcaacaacattctataactgataactccctgagcctcaagacacctgcggagtgtctgctctatccccttccaccctcagcggatgataatctcaagacacctccgagtgtctgctcactccccttccaccctcagctccaccctcagcggatgataatctcaagacacctcccaagtgtgtctgctcactccccttccaccctcagtggatgataatctgaagaaactaacgaagaataaataaataatataaaaataaaatgaatactgcagtcc

SEQ ID NO: 368798 - DNA, 459 bp, Homo sapiens
ctcatccctgtcctgagcaggtctgagctgccgcccgctgaccactgccctcgtcctgcaggtggctgggagcccgagccccacacctgccgggcagcaggtgctggacatcgacagctgcctggactcgtccgtgctggacagctccttcctcacgttctcaggcctccacgctgagtgaccttgaggaaccctgggagctcaggaaggaaggagcgcccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgagtatactaactttctgtagaggtatacttgtaatcacaaataagagtaaattatatgaaaca

SEQ ID NO: 368799 - DNA, 550 bp, Homo sapiens
cacagtggcatgtggagacaacagtgtgtcccagtgacttttctttaccccccagctgtcggcagtactcagtggaagggtgatatgacactgatactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagcagagcatcgtcattcttcaggattgccctgctggccctacctcacagctgaaactttaaaaaacaggatgggccaccagccacctcctccaactcaacaacattctataactgataactccctgagcctcaagacacctgcggagtgtctgctctatccccttccaccctcagcggatgataatctcaagacctcccaagtgtgtctgctcactccccttccaccctcagtggatgataatctgaagaaactaacgaagaataaataaataatataaaaataaaatgaatactgcagtcc

SEQ ID NO: 368800 - DNA, 1233 bp, Homo sapiens
ggttcttcctgccatcctgccatcattgttttttatgttttgtcgccaaaagtgaccttgaggaaccctgggagctcaggaaggaaggagcgcccagaagcagggacagggagctggttggggtggaccagaaatcaggttatcaatactctggctgaccatcgtcatcgtgggactgactttggtggaagtccttggttacttatcattactgtgtttctgagaagttataaatttgccatctccctctgcacaacttacctttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaggttcgagctaaaatccgtaagatgaaggtgacaacaaaagtcaaccgtcatgacaaaatcaatggaaagaagaagaccgccaaagaacatctgaggaaactaagcatgaaagaacgtgagcacggagaaaaggagaggcaggtgtcagaggcagaggaaaacgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagcagagcatcgtcattcttcaggattgccctgctggccctacctcacagctgaaactttaaaaaacaggatgggccaccagccacctcctccaactcaacaacattctataactgataactccctgagcctcaagacacctgcggagtgtctgctctatccccttccaccctcagcggatgataatctcaagacacctccgagtgtctgctcactccccttccaccctcagctccaccctcagcggatgataatctcaagacacctcccaagtgtgtctgctcactccccttccaccctcagtggatgataatctgaagaaactaacgaagaataaataaataatataaaaataaaatgaatactgcagtcc

SEQ ID NO: 368801 - DNA, 1273 bp, Homo sapiens
ctcatccctgtcctgagcaggtctgagctgccgcccgctgaccactgccctcgtcctgcaggtggctgggagcccgagccccacacctgccgggcagcaggtgctggacatcgacagctgcctggactcgtccgtgctggacagctccttcctcacgttctcaggcctccacgctgaggttatcaatactctggctgaccatcgtcatcgtgggactgactttggtggaagtccttggttacttatcattactgtgtttctgagaagttataaatttgccatctccctctgcacaacttacctttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaggttcgagctaaaatccgtaagatgaaggtgacaacaaaagtcaaccgtcatgacaaaatcaatggaaagaagaagaccgccaaagaacatctgaggaaactaagcatgaaagaacgtgagcacggagaaaaggagaggcaggtgtcagaggcagaggaaaacgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagcagagcatcgtcattcttcaggattgccctgctggccctacctcacagctgaaactttaaaaaacaggatgggccaccagccacctcctccaactcaacaacattctataactgataactccctgagcctcaagacacctgcggagtgtctgctctatccccttccaccctcagcggatgataatctcaagacacctccgagtgtctgctcactccccttccaccctcagctccaccctcagcggatgataatctcaagacacctcccaagtgtgtctgctcactccccttccaccctcagtggatgataatctgaagaaactaacgaagaataaataaataatataaaaataaaatgaatactgcagtcc

SEQ ID NO: 368802 - DNA, 1351 bp, Homo sapiens
ctcatccctgtcctgagcaggtctgagctgccgcccgctgaccactgccctcgtcctgcaggtggctgggagcccgagccccacacctgccgggcagcaggtgctggacatcgacagctgcctggactcgtccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagagtgaccttgaggaaccctgggagctcaggaaggaaggagcgcccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaggttcgagctaaaatccgtaagatgaaggtgacaacaaaagtcaaccgtcatgacaaaatcaatggaaagaagaagaccgccaaagaacatctgaggaaactaagcatgaaagaacgtgagcacggagaaaaggagaggcaggtgtcagaggcagaggaaaacgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagcagagcatcgtcattcttcaggattgccctgctggccctacctcacagctgaaactttaaaaaacaggatgggccaccagccacctcctccaactcaacaacattctataactgataactccctgagcctcaagacacctgcggagtgtctgctctatccccttccaccctcagcggatgataatctcaagacacctccgagtgtctgctcactccccttccaccctcagctccaccctcagcggatgataatctcaagacacctcccaagtgtgtctgctcactccccttccaccctcagtggatgataatctgaagaaactaacgaagaataaataaataatataaaaataaaatgaatactgcagtcc

SEQ ID NO: 368803 - DNA, 1193 bp, Homo sapiens
gcctggccaaaatatataaccttaagtgttatcaatactctggctgaccatcgtcatcgtgggactgactttggtggaagtccttggttacttatcattactgtgtttctgagaagttataaatttgccatctccctctgcacaacttacctttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaggttcgagctaaaatccgtaagatgaaggtgacaacaaaagtcaaccgtcatgacaaaatcaatggaaagaagaagaccgccaaagaacatctgaggaaactaagcatgaaagaacgtgagcacggagaaaaggagaggcaggtgtcagaggcagaggaaaacgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagcagagcatcgtcattcttcaggattgccctgctggccctacctcacagctgaaactttaaaaaacaggatgggccaccagccacctcctccaactcaacaacattctataactgataactccctgagcctcaagacacctgcggagtgtctgctctatccccttccaccctcagcggatgataatctcaagacacctccgagtgtctgctcactccccttccaccctcagctccaccctcagcggatgataatctcaagacacctcccgagtgtgtctgctcactccccttccaccctcagctccaccctcagcggatgataatctcaagacacctcccaagtgtgtctgctcactccccttccaccctcagtggatgataatctgaagaaactaacgaagaataaataaataatataaaaataaaatgaatactgcagtcc

SEQ ID NO: 368804 - DNA, 1367 bp, Homo sapiens
gtcgacacagtcgctgttggcctggtgtccagcgtggttgtctatcccgtctacctggccatcctctttctcttccggatgtcccggagcaaggtggctgggagcccgagccccacacctgccgggcagcaggtgctggacatcgacagctgcctggactcgtccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaacgggaaattggatatgaaagaaatacacacctacatggaaatgtttcaacgtgcgcaagcgttgcggcggcgggcagaggactactacagatgcaaaatcaccccttctgcaagaaagcctctttgcaaccggtgcacttacaatttggtattacctgggagtgaaaagaaatattacagccatgcctaactgacttcttgaggtcagaatggcggcagcagagcatcgtcattcttcaggattgccctgctggccctacctcacagctgaaactttaaaaaacaggatgggccaccagccacctcctccaactcaacaacattctataactgataactccctgagcctcaagacacctgcggagtgtctgctctatccccttccaccctcagcggatgataatctcaagacacctccgagtgtctgctcactccccttccaccctcagctccaccctcagcggatgataatctcaagacacctcccaagtgtgtctgctcactccccttccaccctcagtggatgataatctgaagaaactaacgaagaataaataaataatataaaaataaaatgaatactgcagtcc

SEQ ID NO: 368805 - DNA, 1422 bp, Homo sapiens
gtcgacacagtcgctgttggcctggtgtccagcgtggttgtctatcccgtctacctggccatcctctttctcttccggatgtcccggagcaaggtggctgggagcccgagccccacacctgccgggcagcaggtgctggacatcgacagctgcctggactcgtccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaacgggaaattggatatgaaagaaatacacacctacatggaaatgtttcaacgtgcgcaagcgttgcggcggcgggcagaggactactacagatgcaaaatcaccccttctgcaagaaagcctctttgcaaccggtgcacttacaatttggtattacctgggagtgaaaagaaatattacagccatgcctaactgacttcttgaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtctgctcactccccttccaccctcagctctaccctcagcggatgataatctcaagacacctgcggagtgtctgctctatccccttccaccctcagcggatgataatctcaagacacctcccgagtgtctgctcactccccttccaccctcagctccaccctcagtggatgataatctcaagacacctcccgagtgtgtctgctcactccccttccaccctcagcggatgataatctcaagaaactaaggaagaataaataaataatataaaaataaaa

SEQ ID NO: 368806 - DNA, 1011 bp, Homo sapiens
ggttcttcctgccatcctgccatcattgttttttatgttttgtcgccaaaagtgaccttgaggaaccctgggagctcaggaaggaaggagcgcccagaagcagggacagggagctggttggggtggaccagaaatcaggttatcaatactctggctgaccatcgtcatcgtgggactgactttggtggaagtccttggttacttatcattactgtgtttctgagaagttataaatttgccatctccctctgcacaacttacctttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaggttcgagctaaaatccgtaagatgaaggtgacaacaaaagtcaaccgtcatgacaaaatcaatggaaagaagaagaccgccaaagaacatctgaggaaactaagcatgaaagaacgtgagcacggagaaaaggagaggcaggtgtcagaggcagaggaaaacgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagcagagcatcgtcattcttcaggattgccctgctggccctacctcacagctgaaactttaaaaaacaggatgggccaccagccacctcctccaactcaacaacattctcccactcctgatttccaccttgccagggtacccgagctcgaa

SEQ ID NO: 368807 - DNA, 1479 bp, Homo sapiens
gtcgacacagtcgctgttggcctggtgtccagcgtggttgtctatcccgtctacctggccatcctctttctcttccggatgtcccggagcaaggtggctgggagcccgagccccacacctgccgggcagcaggtgctggacatcgacagctgcctggactcgtccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaacgggaaattggatatgaaagaaatacacacctacatggaaatgtttcaacgtgcgcaagcgttgcggcggcgggcagaggactactacagatgcaaaatcaccccttctgcaagaaagcctctttgcaaccggtgcacttacaatttggtattacctgggagtgaaaagaaatattacagccatgcctaactgacttcttgaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagcgtctgctctatccccttccaccctcagcggatgataatctcaagacaccttccgagtgtctgctcactccccttccaccctcagctctaccctcagcggatgataatctcaagacacctgcggagtgtctgctctatccccttccaccctcagcggatgataatctcaagacacctcccgagtgtctgctcactccccttccaccctcagctccaccctcagtggatgataatctcaagacacctcccgagtgtgtctgctcactccccttccaccctcagcggatgataatctcaagaaactaaggaagaataaataaataatataaaaataaaa

SEQ ID NO: 368808 - DNA, 1297 bp, Homo sapiens
gtcgacacagtcgctgttggcctggtgtccagcgtggttgtctatcccgtctacctggccatcctctttctcttccggatgtcccggagcaaggtggctgggagcccgagccccacacctgccgggcagcaggtgctggacatcgacagctgcctggactcgtccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaacgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagcagagcatcgtcattcttcaggattgccctgctggccctacctcacagctgaaactttaaaaaacaggatgggccaccagccacctcctccaactcaacaacattctataactgataactccctgagcctcaagacacctgcggagtgtctgctctatccccttccaccctcagcggatgataatctcaagacacctccgagtgtctgctcactccccttccaccctcagctccaccctcagcggatgataatctcaagacacctcccaagtgtgtctgctcactccccttccaccctcagtggatgataatctgaagaaactaacgaagaataaataaataatataaaaataaaatgaatactgcagtcc

SEQ ID NO: 368809 - DNA, 1171 bp, Homo sapiens
ggttcttcctgccatcctgccatcattgttttttatgttttgtcgccaaaagtgaccttgaggaaccctgggagctcaggaaggaaggagcgcccagaagcagggacagggagctggttggggtggaccagaaatcaggttatcaatactctggctgaccatcgtcatcgtgggactgactttggtggaagtccttggttacttatcattactgtgtttctgagaagttataaatttgccatctccctctgcacaacttacctttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaggttcgagctaaaatccgtaagatgaaggtgacaacaaaagtcaaccgtcatgacaaaatcaatggaaagaagaagaccgccaaagaacatctgaggaaactaagcatgaaagaacgtgagcacggagaaaaggagaggcaggtgtcagaggcagaggaaaacgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttggtaaccgtgttgcgcaaaaacaccttcatccccacccagtggggcccccatctaatattctaagtgtcagaggttccgtatttgtaatagcaaatgggccctgactgtaaattagtgaagagtgactgtaacttattacccacagggacaattccaaatgagggccttaaatga

SEQ ID NO: 368810 - DNA, 480 bp, Homo sapiens
aggtcacgtcctatatcccaacatcataccttcccagattcattacttgtatcctaaaccaagcttcaggccaccagccacctcctccaactcaacaacattctataattgataactccctgagcctcaagacaccttccgagcgtctgctctatccccttccaccctcagcggatgataatctcaagacaccttccgagtgtctgctcactccccttccaccctcagctctaccctcagcggatgataatctcaagacacctgcggagtgtctgctctatccccttccaccctcagcggatgataatctcaagacacctcccgagtgtctgctcactccccttccaccctcagctccaccctcagtggatgataatctcaagacacctcccgagtgtgtctgctcactccccttccaccctcagcggatgataatctcaagaaactaaggaagaataaataaataatataaaaataaaa

SEQ ID NO: 368811 - DNA, 755 bp, Homo sapiens
cctacacgacattgagtaccgcaagaaatgggacagcaacgtcatcgagacttttgacatcgcccgcttgacagtcaacgctgacgtgggctattactcctgtgagcaggcgtagcacgctgatcccagtccccttggcctccatccaggcctcccaccaagcctccccttccaccctcagctctaccctcagcggatgataatctcaagacacctgcggagtgtctgctctatccccttccaccctcagcggatgataatctcaagacacctcccgagtgtctgctcactccccttccaccctcagctccaccctcagtggatgataatctcaagacacctcccgagtgtgtctgctcactccccttccaccctcagcggatgataatctcaagaaactaaggaagaataaataaataatataaaaataaaaaaaaaaaaaaaaaaaaaaaaaaaaaataaaaaataaaggaccgcactgctaattcctcgtgcaccggataactatgtcgccactctacaaaccctgatggccccacagtcatctttcaccatgtccgacagcatctacaggtcagcatcttttcgagctacaagcttccgcggaccctacttggcaattggctaatctgaaagcactatgtgctttataaatcagctaatatttcacgttacatccggtcatttttttgcgcttaaggccatctccttgcaatggcctttagtcgatgaaattccccttatatcggaggccg

SEQ ID NO: 368812 - DNA, 333 bp, Homo sapiens
tccctgagcctcaagacaccttccgagtgtctgctcactccccttccaccctcagctctaccctcagcggatgataatctcaagacacctgcggagtgtctgctctatccccttccaccctcagcggatgataatctcaagacacctcccgagtgtctgctcactccccttccaccctcagctccaccctcagtggatgataatctcaagacacctcccgagtgtgtctgctcactccccttccaccctcagcggatgataatctcaagaaactaaggaagaataaataaataatataaaaataaaatgaatactgcagtccttatgttattg

SEQ ID NO: 368813 - DNA, 1084 bp, Homo sapiens
atgttttgttgcttaggatatgaatggctgagcggaggctgtaaaacctggcactctgcttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaacgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtctgctcactccccttccaccctcagctctaccctcagcggatgataatctcaagacacctgcggagtgtctgctctatccccttccaccctcagcggatgataatctcaagacacctcccgagtgtctgctcactccccttccaccctcagctccaccctcagtggatgataatctcaagacacctcccgagtgtgtctgctcactccccttccaccctcagcggatgataatctcaagaaactaaggaagaataaataaataatataaaaataaaa

SEQ ID NO: 368814 - DNA, 1122 bp, Homo sapiens
gcctggccaaaatatataaccttaagtgttatcaatactctggctgaccatcgtcatcgtgggactgactttggtggaagtccttggttacttatcattactgtgtttctgagaagttataaatttgccatctccctctgcacaacttacctttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaggttcgagctaaaatccgtaagatgaaggtgacaacaaaagtcaaccgtcatgacaaaatcaatggaaagaagaagaccgccaaagaacatctgaggaaactaagcatgaaagaacgtgagcacggagaaaaggagaggcaggtgtcagaggcagaggaaaacgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagcagagcatcgtcattcttcaggattgccctgctggccctacctcacagctgaaactttaaaaaacaggatgggccaccagccacctcctccaactcaacaacattctataactgataactccctgagcctcaagacacctgcggagtgtctgctctatccccttccaccctcagcggatgataatctcaagacacctccgagtgtctgctcactccccttccaccctcagctccaccctcagcggatgataatctcaagacacctcccaagtgtgtctgctcactccccttccaccctcagtggatgataatctgaagaaactaacgaagaataaataaataatataaaaataaaatgaatactgcagtcc

SEQ ID NO: 368815 - DNA, 1265 bp, Homo sapiens
ctcatccctgtcctgagcaggtctgagctgccgcccgctgaccactgccctcgtcctgcaggtggctgggagcccgagccccacacctgccgggcagcaggtgctggacatcgacagctgcctggactcgtccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaggttcgagctaaaatccgtaagatgaaggtgacaacaaaagtcaaccgtcatgacaaaatcaatggaaagaagaagaccgccaaagaacatctgaggaaactaagcatgaaagaacgtgagcacggagaaaaggagaggcaggtgtcagaggcagaggaaaacgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagcagagcatcgtcattcttcaggattgccctgctggccctacctcacagctgaaactttaaaaaacaggatgggccaccagccacctcctccaactcaacaacattctataactgataactccctgagcctcaagacacctgcggagtgtctgctctatccccttccaccctcagcggatgataatctcaagacacctccgagtgtctgctcactccccttccaccctcagctccaccctcagcggatgataatctcaagacacctcccaagtgtgtctgctcactccccttccaccctcagtggatgataatctgaagaaactaacgaagaataaataaataatataaaaataaaatgaatactgcagtcc

SEQ ID NO: 368816 - DNA, 1019 bp, Homo sapiens
gcctggccaaaatatataaccttaagtgttatcaatactctggctgaccatcgtcatcgtgggactgactttggtggaagtccttggttacttatcattactgtgtttctgagaagttataaatttgccatctccctctgcacaacttacctttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaggttcgagctaaaatccgtaagatgaaggtgacaacaaaagtcaaccgtcatgacaaaatcaatggaaagaagaagaccgccaaagaacatctgaggaaactaagcatgaaagaacgtgagcacggagaaaaggagaggcaggtgtcagaggcagaggaaaacgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagcagagcatcgtcattcttcaggattgccctgctggccctacctcacagctgaaactttaaaaaacaggatgggccaccagccacctcctccaactcaacaacattctataactgataactccctgagcctcaagacacctgcggagtgtctgctctatccccttccaccctcagcggatgataatctcaagacgagtgtcctcttgctcctctgccacactcagtggatgataatctgaagcagtgtcttctggtaacctcctgcgcg

SEQ ID NO: 368817 - DNA, 1453 bp, Homo sapiens
gtcgacacagtcgctgttggcctggtgtccagcgtggttgtctatcccgtctacctggccatcctctttctcttccggatgtcccggagcaaggtggctgggagcccgagccccacacctgccgggcagcaggtgctggacatcgacagctgcctggactcgtccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagagtgaccttgaggaaccctgggagctcaggaaggaaggagcgcccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaacgggaaattggatatgaaagaaatacacacctacatggaaatgtttcaacgtgcgcaagcgttgcggcggcgggcagaggactactacagatgcaaaatcaccccttctgcaagaaagcctctttgcaaccggtgcacttacaatttggtattacctgggagtgaaaagaaatattacagccatgcctaactgacttcttgaggtcagaatggcggcagcagagcatcgtcattcttcaggattgccctgctggccctacctcacagctgaaactttaaaaaacaggatgggccaccagccacctcctccaactcaacaacattctataactgataactccctgagcctcaagacacctgcggagtgtctgctctatccccttccaccctcagcggatgataatctcaagacacctccgagtgtctgctcactccccttccaccctcagctccaccctcagcggatgataatctcaagacacctcccaagtgtgtctgctcactccccttccaccctcagtggatgataatctgaagaaactaacgaagaataaataaataatataaaaataaaatgaatactgcagtcc

SEQ ID NO: 368818 - DNA, 1104 bp, Homo sapiens
gaaacctatataggagcagatctctgactgggcagatgatgagtgactgtactggatgattctaagaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaacgggaaattggatatgaaagaaatacacacctacatggaaatgtttcaacgtgcgcaagcgttgcggcggcgggcagaggactactacagatgcaaaatcaccccttctgcaagaaagcctctttgcaaccggtgcacttacaatttggtattacctgggagtgaaaagaaatattacagccatgcctaactgacttcttgaggtcagaatggcggcagcagagcatcgtcattcttcaggattgccctgctggccctacctcacagctgaaactttaaaaaacaggatgggccaccagccacctcctccaactcaacaacattctataactgataactccctgagcctcaagacacctgcggagtgtctgctctatccccttccaccctcagcggatgataatctcaagacacctccgagtgtctgctcactccccttccaccctcagctccaccctcagcggatgataatctcaagacacctcccaagtgtgtctgctcactccccttccaccctcagtggatgataatctgaagaaactaacgaagaataaataaataatataaaaataaaatgaatactgcagtcc

SEQ ID NO: 368819 - DNA, 636 bp, Homo sapiens
gacagggtttcactgtattagccaggatggtctcaatctcctgacctcgtgatccatccacctcgccctcccagagtgctgggattacaggcatcagccaccgtgaccggctcagactgtactcttacagccatctgaaatacgttttctagggaaatgtttcaacgtgcgcaagcgttgcggcggcgggcagaggactactacagatgcaaaatcaccccttctgcaagaaagcctctttgcaaccgggtcagaatggcggcagcagagcatcgtcattcttcaggattgccctgctggccctacctcacagctgaaactttaaaaaacaggatgggccaccagccacctcctccaactcaacaacattctataactgataactccctgagcctcaagacacctgcggagtgtctgctctatccccttccaccctcagcggatgataatctcaagacacctccgagtgtctgctcactccccttccaccctcagctccaccctcagcggatgataatctcaagacacctcccaagtgtgtctgctcactccccttccaccctcagtggatgataatctgaagaaactaacgaagaataaataaataatataaaaataaaatgaatactgcagtcc

SEQ ID NO: 368820 - DNA, 1744 bp, Homo sapiens
gtcgacacagtcgctgttggcctggtgtccagcgtggttgtctatcccgtctacctggccatcctctttctcttccggatgtcccggagcaaggtggctgggagcccgagccccacacctgccgggcagcaggtgctggacatcgacagctgcctggactcgtccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaacgggaaattggatatgaaagaaatacacacctacatggaaatgtttcaacgtgcgcaagcgttgcggcggcgggcagaggactactacagatgcaaaatcaccccttctgcaagaaagcctctttgcaaccggtgcacttacaatttggtattacctgggagtgaaaagaaatattacagccatgcctaactgacttcttgaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtctgctcactccccttccaccctcagctctaccctcagcggatgataatctcaagacacctgcggagtgtctgctctatccccttccaccctcagcggatgataatctcaagacacctcccgagtgtctgctcactccccttccaccctcagctccaccctcagtggatgataatctcaagacacctcccgagtgtgtctgctcactccccttccaccctcagcggatgataatctcaagaaactaaggaagaataaataaataatataaaaataaaaaaaaaaaaaaaaaaaaaaaaaaaaaataaaaaataaaggaccgcactgctaattcctcgtgcaccggataactatgtcgccactctacaaaccctgatggccccacagtcatctttcaccatgtccgacagcatctacaggtcagcatcttttcgagctacaagcttccgcggaccctacttggcaattggctaatctgaaagcactatgtgctttataaatcagctaatatttcacgttacatccggtcatttttttgcgcttaaggccatctccttgcaatggcctttagtcgatgaaattccccttatatcggaggccg

SEQ ID NO: 368821 - DNA, 754 bp, Homo sapiens
gtcgacacagtcgctgttggcctggtgtccagcgtggttgtctatcccgtctacctggccatcctctttctcttccggatgtcccggagcaaggtggctgggagcccgagccccacacctgccgggcagcaggtgctggacatcgacagctgcctggactcgtccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgtggtaatcagcgcatgctggtaagagcgtctctgcctggtatagc

SEQ ID NO: 368822 - DNA, 1862 bp, Homo sapiens
gggcgtctccgcagctcggctcccgcgcgctcagcaccgccagcggcggccagatgcaggcggagcgaggagctcggggaggccgtgggcggcggccaggccgcggccggcctggcggagatcgccacagcgagcggcccggagccgcagcggcggtagccagaggcggcggcggaggcggcggcggggacggaggcggacgccggggccgtggccgtggccggggcttccgcggcgctcgcggaggccgaggaggaggaggcgccccgcgaggcagccgccgggagccgggaggctggggcgcaggggccagcgcgccggttgaagatgacagcgatgcagagacctatggagaagagaatgatgaacagggaaattattctaaaagaaagattgtctctaactgggatcgatatcaagatattgaaaaagaggtcaataatgaaagtggagagtcacagaggggaacagatttcagtgtcctccttagctctgcaggggactcattctcacagttccggtttgctgaggagaaagaatgggatagtgaagcttcttgtccaaaacagaattcagcattttatgtggatagtgagttattggttcgagcccttcaagagctgcctctctgcctccgactcaacgttgctgccgaactggtccagggtacagttcctttagaggttcctcaggtgaaaccaaagagaactgatgatggcaagggattagggatgcagttaaaggggcccttggggcctggaggaagggggcccatctttgagctgaaatctgtggctgctggctgccctgtgttgctgggcaaagacaacccaagcccgggtccttcaagggattctcagaaacccacttccccactgcagtcagcaggagaccatttggaagaagaactagatctgttgcttaatttagatgcacctataaaagagggagataacatcttaccagatcagacgtctcaggacctgaaatccaaggaagatggggaggtggtccaagaggaagaagtttgtgcaaaaccatctgtgactgaagaaaaaaacatggaacctgagcaaccaagtacctccaaaaatgttaccgaggaagagctggaagactggttggacagcatgatttcctaaaaaggggaaaaaaagtgcctgaagcaaatcttggttgccttctaacggcaggtgggcataaggctgtccttcaggaccagccagtttacaagcatgtctcaagctagtgtgttccattatgctcacagcagtaaatgcctacctctgtgtttgacatctgaaagaatacattgaagcagcttgttgcatttgtttttctggcttagtaatctaatagatttccttaagggcaggagatagactctggcccttgtttctagcctccttccttgcagtgtttacaacatagccagtgtttacagcatagcagatgctgctgctgattaagagaatagatgcaaacaaggcatgcatttggccaaaataaacaaatgctggtctgtccagttttcctttcctttcttgtgtggggccctgggcaattcgtctcatgtcccctttcccagcagtcacagagtggttgtagaatcaaccagaagtggtacattccaagagtccagaccctggaggtattggtacgtattactttattgcagtgggcacttcattgtatttgaggagattcacctaaacagagcagctccactacttacaagggaccataaagcattactccattttggcataaggttgagattttttttctgaattttcagtacagtacttttcttctaataacagcagttgactgacagctgttactaaaaaaacttgtatgaa

SEQ ID NO: 368823 - DNA, 1262 bp, Homo sapiens
gggcgtctccgcagctcggctcccgcgcgctcagcaccgccagcggcggccagatgcaggcggagcgaggagctcggggaggccgtgggcggcggccaggccgcggccggcctggcggagatcgccacagcgagcggcccggagccgcagcggcggtagccagaggcggcggcggaggcggcggcggggacggaggcggacgccggggccgtggccgtggccggggcttccgcggcgctcgcggaggccgaggaggaggaggcgccccgcgaggcagccgccgggagccgggaggctggggcgcaggggccagcgcgccggttgaagatgacagcgatgcagagacctatggagaagagaatgatgaacagggaaattattctaaaagaaagattgtctctaactgggatcgatatcaagatattgaaaaagaggtcaataatgaaagtggagagtcacagaggggaacagatttcagtgtcctccttagctctgcaggggactcattctcacagttccggtttgctgaggagaaagaatgggatagtgaagcttcttgtccaaaacagaattcagcattttatgtggatagtgagttattggttcgagcccttcaagagctgcctctctgcctccgactcaacgttgctgccgaactggtccagatgcacctataaaagagggagataacatcttaccagatcagacgtctcaggacctgaaatccaaggaagatggggaggtggtccaagaggaagaagtttgtgcaaaaccatctgtgactgaagaaaaaaacatggaacctgagcaaccaagtacctccaaaaatgttaccgaggaagagctggaagactggttggacagcatgatttcctaaaaaggggaaaaaaagtgcctgaagcaaatcttggttgccttctaacggcaggtgggcataaggctgtccttcaggaccagccagtttacaagcatgtctcaagctagtgtgttccattatgctcacagcagtaaatgcctacctctgtgtttgacatctgaaagaatacattgaagcagcttgttgcatttgtttttctggcttagtaatctaatagatttccttaagggcaggagatagactctggcccttgtttctagcctccttccttgcagtgtttacaacatagccagtgtttacagcatagcagatgctgctgctgattaagagaatagatgcaaacaaggcatgcatttggccaaaataaacaaatgctggtctgtcc

SEQ ID NO: 368824 - DNA, 1411 bp, Homo sapiens
gggcgtctccgcagctcggctcccgcgcgctcagcaccgccagcggcggccagatgcaggcggagcgaggagctcggggaggccgtgggcggcggccaggccgcggccggcctggcggagatcgccacagcgagcggcccggagccgcagcggcggtagccagaggcggcggcggaggcggcggcggggacggaggcggacgccggggccgtggccgtggccggggcttccgcggcgctcgcggaggccgaggaggaggaggcgccccgcgaggcagccgccgggagccgggaggctggggcgcaggggccagcgcgccggttgaagatgacagcgatgcagagacctatggagaagagaatgatgaacagggaaattattctaaaagaaagattgtctctaactgggatcgatatcaagatattgaaaaagaggtcaataatgaaagtggagagtcacagaggggaacagatttcagtgtcctccttagctctgcaggggactcattctcacagttccggtttgctgaggagaaagaatgggatagtgaagcttcttgtccaaaacagaattcagcattttatgtggatagtgagttattggttcgagcccttcaagagctgcctctctgcctccgactcaacgttgctgccgaactggtccagggtacagttcctttagaggttcctcaggtgaaaccaaagagaactgatgatggcaagggattagggatgcagttaaaggggcccttggggcctggaggaagggggcccatctttgagctgaaatctgtggctgctggctgccctgtgttgctgggcaaagacaacccaagcccgggtccttcaagggattctcagaaacccacttccccactgcagtcagcaggagaccatttggaagaagaactagatctgttgcttaatttagatgcacctataaaagagggagataacatcttaccagatcagacgtctcaggacctgaaatccaaggaagatggggaggtggtccaagaggaagaaggcatgtgcaaagagatcaaacatcagaggcagccttgttttataacgataccctctcagtgtaactagttcagccccttgacagcaagaactcactctcatgtgaaaggcattaatccctcttaatgacctaatcaccttttaaaggcaccacttcccaataccactatattggagaccaagcctcaacatgagttttggtcaggacaaacgacatttaaaccataaaagtcagaggaaaagaacaaaatagaaggacaagcagcagaaatctgacaactagatagttgatcttctctgatgaaaaaaatagaagagtccagtccaaagccacttaagaatagggttttagggaactgcgaaccggtccgagctcgatcgtatca

SEQ ID NO: 368825 - DNA, 1527 bp, Homo sapiens
gggcgtctccgcagctcggctcccgcgcgctcagcaccgccagcggcggccagatgcaggcggagcgaggagctcggggaggccgtgggcggcggccaggccgcggccggcctggcggagatcgccacagcgagcggcccggagccgcagcggcggtagccagaggcggcggcggaggcggcggcggggacggaggcggacgccggggccgtggccgtggccggggcttccgcggcgctcgcggaggccgaggaggaggaggcgccccgcgaggcagccgccgggagccgggaggctggggcgcaggggccagcgcgccggttgaagatgacagcgatgcagagacctatggagaagagaatgatgaacagggaaattattctaaaagaaagattgtctctaactgggatcgatatcaagatattgaaaaagaggtcaataatgaaagtggagagtcacagaggggaacagatttcagtgtcctccttagctctgcaggggactcattctcacagttccggtttgctgaggagaaagaatgggatagtgaagcttcttgtccaaaacagaattcagcattttatgtggatagtgagttattggttcgagcccttcaagagctgcctctctgcctccgactcaacgttgctgccgaactggtccagggtacagttcctttagaggttcctcaggtgaaaccaaagagaactgatgatggcaagggattagggatgcagttaaaggggcccttggggcctggaggaagggggcccatctttgagctgaaatctgtggctgctggctgccctgtgttgctgggcaaagacaacccaagcccgggtccttcaagggattctcagaaacccacttccccactgcagtcagcaggagaccatttggaagaagaactagatctgttgcttaatttagatgcacctataaaagagggagataacatcttaccagatcagacgtctcaggacctgaaatccaaggaagatggggaggtggtccaagaggaagaagtttgtgcaaaaccatctgtgactgaagaaaaaaacatggaacctgagcaaccaagtacctccaaaaatgttaccgaggaagagctggaagactggttggacagcatgatttcctaaaaaggggaaaaaaagtgcctgaagcaaatcttggttgccttctaacggcaggtgggcataaggctgtccttcaggaccagccagtttacaagcatgtctcaagctagtgtgttccattatgctcacagcagtaaatgcctacctctgtgtttgacatctgaaagaatacattgaagcagcttgttgcatttgtttttctggcttagtaatctaatagatttccttaagggcaggagatagactctggcccttgtttctagcctccttccttgcagtgtttacaacatagccagtgtttacagcatagcagatgctgctgctgattaagagaatagatgcaaacaaggcatgcatttggccaaaataaacaaatgctggtctgtcc

SEQ ID NO: 368826 - DNA, 930 bp, Homo sapiens
gggcctcccacttggttgcggcctctcacttggtggcctcccacttggttgctgccgaactggtccagggtacagttcctttagaggttcctcaggtgaaaccaaagagaactgatgatggcaagggattagggatgcagttaaaggggcccttggggcctggaggaagggggcccatctttgagctgaaatctgtggctgctggctgccctgtgttgctgggcaaagacaacccaagcccgggtccttcaagggattctcagaaacccacttccccactgcagtcagcaggagaccatttggaagaagaactagatctgttgcttaatttagatgcacctataaaagagggagataacatcttaccagatcagacgtctcaggacctgaaatccaaggaagatggggaggtggtccaagaggaagaagtttgtgcaaaaccatctgtgactgaagaaaaaaacatggaacctgagcaaccaagtacctccaaaaatgttaccgaggaagagctggaagactggttggacagcatgatttcctaaaaaggggaaaaaaagtgcctgaagcaaatcttggttgccttctaacggcaggtgggcataaggctgtccttcaggaccagccagtttacaagcatgtctcaagctagtgtgttccattatgctcacagcagtaaatgcctacctctgtgtttgacatctgaaagaatacattgaagcagcttgttgcatttgtttttctggcttagtaatctaatagatttccttaagggcaggagatagactctggcccttgtttctagcctccttccttgcagtgtttacaacatagccagtgtttacagcatagcagatgctgctgctgattaagagaatagatgcaaacaaggcatgcatttggccaaaataaacaaatgctggtctgtcc

SEQ ID NO: 368827 - DNA, 3104 bp, Homo sapiens
tgggagaattcagctgagagacagaggtcagacatgccagcagggttggaaagaggcaggtacggaagctgagctgcagagttagccggcatctgacagaaaaatgtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagcttgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggttcagaagcacctagacctgtccaatgtggctggctacaaagccatttaccatgacctggagcagagcatcagagcagctgatgcagtggaggacctgaggtggttccgagccaatcacgggccaggcatggccatgaactggccgcagtttgaggagtggtccgcagacctgaatcgaaccctcagccggagagagaagaagaaggccactgacggcgtcaccctgacgggcatcaaccagacaggcgaccagtctctgccgagtaagcccagcagtgtgagcagctacgagaagacccagagctatcccaccgactggtcagacgatgagtctaacaaccccttctcctccacggatgccaatggggactcgaatccattcgacgacgacgccacctcggggacggaagtgcgagtccgggccctgtatgactatgaggggcaggagcatgatgagctgagcttcaaggctggggatgagctgaccaagatggaggacgaggatgagcagggctggtgcaagggacgcttggacaacgggcaagttggcctatacccggcaaattatgtggaggcgatccagtgatgagtcggggacaggccagcggggggacggaggcggcgggcccaggagcctcagccagccacgtgggcatccactccttttcctgcaagagatgatggttccattgctcttggcttcatggtgttcctggaaggcagatgagctggtcatttcgcctgggactcggcacctttccgagtgcagctggagggatctgagcgcaggaagacgcagaacaacagaaatagccgcccctccccgcccactgtgcctgttggcctatcatagatctctatgttcttgactttgtctctcctttccgagtcaatggtgggttacactgatcttgttccactgattactctctctgacgagtccatcacctgcaacttaaatgaacaagcttacatcccattttgagtgaagattttgaggtttttaatttaaaggctgtgtacagttatacttttttatacacctgttcatttctacttaaattatggcacagattgatgcgcaccagtcttgaggaaacgatctccctattcccttaccctgttactcagccacgccgtgtgtaggcttagcctcaggtggcagatgtttgaggaaaggaattatgccaggaaggtgggaccgggttatggtcgggtttctattgggaatgctctttgtgcttttgggcatctgaatggaagctttacatagaaccttaggtagaactcccccaaatcgccatatttaaaaattattttcactctattcttgcttaaaactgtactcttttgcaaattaacaattttatcactgattcagagttaaaaagaagactaacttttcaagcaaatgcatctgtaaagatgctttagattagactgtcatgtctcagtgtctatctgtatatattatttgatattcagagaatctaaagcactcgtctactgttttaatgagatttaacagcttttaacagtgagtttcgtttgtaaactgcttgaagtctgtggcattcaggcacacgtctggctggccggctgggtctcctcccgggctcagtgggcctggggcctctctgacgtggtgcctgctggagggaggctcgtcgtcaccagctgactgctggtccggcttctgaccggcctttgtcctggctccgtagcagaacactgtaaaagtgcccgcgtctttgcagtagttgcagatttcagtcgtcgtgttacttgtgcacaaacagaagctgggtcttacccgcagcacgagtgtctcgggctgcccggagtcgcccgggagcaggtgctgcagccagagttacgcgggggccacgcgggccggcgggggtggggggaacgtgggggaacctgtgtttcacgtgactcagcagtgcccgccgccgtcaccagctatgcattcactccgtttccagtgagcagatgtcttgcttggaaagtggacctgtgtctgtgtctgtcctgagaacttaccagcagaaatcctcatttctgtgctacggatttaccaaaaattgtcaagtctttttcagtttaacagttcctttacatgtgtagtatttgaggaaaaaaatcaataaacagttgatctcgtgca

SEQ ID NO: 368828 - DNA, 3274 bp, Homo sapiens
  misc_feature (3)..(3): n is a, c, g, or t
ggnagagctgtcccactgggcaggtgcctctgacggagaggaggcgtcgtcgggaagtatgtggccgtggctgctctggcatgatcctgaagactggcacgaaggggaatggagccgcacagagaatttcaggcatcagaggggaagcgcaggtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagcttgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggttcagaagcacctagacctgtccaatgtggctggctacaaagccatttaccatgacctggagcagagcatcagagcagctgatgcagtggaggacctgaggtggttccgagccaatcacgggccaggcatggccatgaactggccgcagtttgaggagtggtccgcagacctgaatcgaaccctcagccggagagagaagaagaaggccactgacggcgtcaccctgacgggcatcaaccagacaggcgaccagtctctgccgagtaagcccagcagcacccttaatgtcccgagcaaccccgcccagtctgcgcagtcacagtccagctacaaccccttcgaggatgaggacgacacgggcagcaccgtcagtgagaaggacgacactaaggccaaaaatgtgagcagctacgagaagacccagagctatcccaccgactggtcagacgatgagtctaacaaccccttctcctccacggatgccaatggggactcgaatccattcgacgacgacgccacctcggggacggaagtgcgagtccgggccctgtatgactatgaggggcaggagcatgatgagctgagcttcaaggctggggatgagctgaccaagatggaggacgaggatgagcagggctggtgcaagggacgcttggacaacgggcaagttggcctatacccggcaaattatgtggaggcgatccagtgatgagtcggggacaggccagcggggggacggaggcggcgggcccaggagcctcagccagccacgtgggcatccactccttttcctgcaagagatgatggttccattgctcttggcttcatggtgttcctggaaggcagatgagctggtcatttcgcctgggactcggcacctttccgagtgcagctggagggatctgagcgcaggaagacgcagaacaacagaaatagccgcccctccccgcccactgtgcctgttggcctatcatagatctctatgttcttgactttgtctctcctttccgagtcaatggtgggttacactgatcttgttccactgattactctctctgacgagtccatcacctgcaacttaaatgaacaagcttacatcccattttgagtgaagattttgaggtttttaatttaaaggctgtgtacagttatacttttttatacacctgttcatttctacttaaattatggcacagattgatgcgcaccagtcttgaggaaacgatctccctattcccttaccctgttactcagccacgccgtgtgtaggcttagcctcaggtggcagatgtttgaggaaaggaattatgccaggaaggtgggaccgggttatggtcgggtttctattgggaatgctctttgtgcttttgggcatctgaatggaagctttacatagaaccttaggtagaactcccccaaatcgccatatttaaaaattattttcactctattcttgcttaaaactgtactcttttgcaaattaacaattttatcactgattcagagttaaaaagaagactaacttttcaagcaaatgcatctgtaaagatgctttagattagactgtcatgtctcagtgtctatctgtatatattatttgatattcagagaatctaaagcactcgtctactgttttaatgagatttaacagcttttaacagtgagtttcgtttgtaaactgcttgaagtctgtggcattcaggcacacgtctggctggccggctgggtctcctcccgggctcagtgggcctggggcctctctgacgtggtgcctgctggagggaggctcgtcgtcaccagctgactgctggtccggcttctgaccggcctttgtcctggctccgtagcagaacactgtaaaagtgcccgcgtctttgcagtagttgcagatttcagtcgtcgtgttacttgtgcacaaacagaagctgggtcttacccgcagcacgagtgtctcgggctgcccggagtcgcccgggagcaggtgctgcagccagagttacgcgggggccacgcgggccggcgggggtggggggaacgtgggggaacctgtgtttcacgtgactcagcagtgcccgccgccgtcaccagctatgcattcactccgtttccagtgagcagatgtcttgcttggaaagtggacctgtgtctgtgtctgtcctgagaacttaccagcagaaatcctcatttctgtgctacggatttaccaaaaattgtcaagtctttttcagtttaacagttcctttacatgtgtagtatttgaggaaaaaaatcaataaacagttgatctcgtgca

SEQ ID NO: 368829 - DNA, 3541 bp, Homo sapiens
gagtcccttgggagaggaaactttctgaaagactgtaggattaccttccctgaacttccggtcaggtgcggtgctgccctgccgcgccctcttacccctggatgccgacgaaaccgcaaaactccagccccgggaagcgcgtctcaaggaccaccaccagcgagcggctttgggagagtgatctgcgccaccctcgcagcccattaaataggcactccccgtttgattgacaggagaagtcaccaatgcgcgtcctggggctttccctcgtcctcacgcggggtgagccgcctctctactcatctggcccaatcgggggcgccggggaggctgtggggcggggctcggtgtccggtagccaatggacagagcccagcgggagcggcgggggcggtgcggtcgcggctggcggcagaagcggccgcaggggtctgggcagggctgggcagtgctgccggagcaaaagcggtagcgggagcccggccggagctgggtctggagacgccgtggcagcctgaacggagtgtgcgacggattgggaggtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagcttgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggttcagaagcacctagacctgtccaatgtggctggctacaaagccatttaccatgacctggagcagagcatcagagcagctgatgcagtggaggacctgaggtggttccgagccaatcacgggccaggcatggccatgaactggccgcagtttgaggagtggtccgcagacctgaatcgaaccctcagccggagagagaagaagaaggccactgacggcgtcaccctgacgggcatcaaccagacaggcgaccagtctctgccgagtaagcccagcagtgtgagcagctacgagaagacccagagctatcccaccgactggtcagacgatgagtctaacaaccccttctcctccacggatgccaatggggactcgaatccattcgacgacgacgccacctcggggacggaagtgcgagtccgggccctgtatgactatgaggggcaggagcatgatgagctgagcttcaaggctggggatgagctgaccaagatggaggacgaggatgagcagggctggtgcaagggacgcttggacaacgggcaagttggcctatacccggcaaattatgtggaggcgatccagtgatgagtcggggacaggccagcggggggacggaggcggcgggcccaggagcctcagccagccacgtgggcatccactccttttcctgcaagagatgatggttccattgctcttggcttcatggtgttcctggaaggcagatgagctggtcatttcgcctgggactcggcacctttccgagtgcagctggagggatctgagcgcaggaagacgcagaacaacagaaatagccgcccctccccgcccactgtgcctgttggcctatcatagatctctatgttcttgactttgtctctcctttccgagtcaatggtgggttacactgatcttgttccactgattactctctctgacgagtccatcacctgcaacttaaatgaacaagcttacatcccattttgagtgaagattttgaggtttttaatttaaaggctgtgtacagttatacttttttatacacctgttcatttctacttaaattatggcacagattgatgcgcaccagtcttgaggaaacgatctccctattcccttaccctgttactcagccacgccgtgtgtaggcttagcctcaggtggcagatgtttgaggaaaggaattatgccaggaaggtgggaccgggttatggtcgggtttctattgggaatgctctttgtgcttttgggcatctgaatggaagctttacatagaaccttaggtagaactcccccaaatcgccatatttaaaaattattttcactctattcttgcttaaaactgtactcttttgcaaattaacaattttatcactgattcagagttaaaaagaagactaacttttcaagcaaatgcatctgtaaagatgctttagattagactgtcatgtctcagtgtctatctgtatatattatttgatattcagagaatctaaagcactcgtctactgttttaatgagatttaacagcttttaacagtgagtttcgtttgtaaactgcttgaagtctgtggcattcaggcacacgtctggctggccggctgggtctcctcccgggctcagtgggcctggggcctctctgacgtggtgcctgctggagggaggctcgtcgtcaccagctgactgctggtccggcttctgaccggcctttgtcctggctccgtagcagaacactgtaaaagtgcccgcgtctttgcagtagttgcagatttcagtcgtcgtgttacttgtgcacaaacagaagctgggtcttacccgcagcacgagtgtctcgggctgcccggagtcgcccgggagcaggtgctgcagccagagttacgcgggggccacgcgggccggcgggggtggggggaacgtgggggaacctgtgtttcacgtgactcagcagtgcccgccgccgtcaccagctatgcattcactccgtttccagtgagcagatgtcttgcttggaaagtggacctgtgtctgtgtctgtcctgagaacttaccagcagaaatcctcatttctgtgctacggatttaccaaaaattgtcaagtctttttcagtttaacagttcctttacatgtgtagtatttgaggaaaaaaatcaataaacagttgatctcgtgca

SEQ ID NO: 368830 - DNA, 3212 bp, Homo sapiens
tctttccagaagacattccaaccaccatggtagagtcacagtaatgtcatggagaatgaagggagtcggggactaaacaagtggctgcaggtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagcttgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggttcagaagcacctagacctgtccaatgtggctggctacaaagccatttaccatgacctggagcagagcatcagagcagctgatgcagtggaggacctgaggtggttccgagccaatcacgggccaggcatggccatgaactggccgcagtttgaggagtggtccgcagacctgaatcgaaccctcagccggagagagaagaagaaggccactgacggcgtcaccctgacgggcatcaaccagacaggcgaccagtctctgccgagtaagcccagcagcacccttaatgtcccgagcaaccccgcccagtctgcgcagtcacagtccagctacaaccccttcgaggatgaggacgacacgggcagcaccgtcagtgagaaggacgacactaaggccaaaaatgtgagcagctacgagaagacccagagctatcccaccgactggtcagacgatgagtctaacaaccccttctcctccacggatgccaatggggactcgaatccattcgacgacgacgccacctcggggacggaagtgcgagtccgggccctgtatgactatgaggggcaggagcatgatgagctgagcttcaaggctggggatgagctgaccaagatggaggacgaggatgagcagggctggtgcaagggacgcttggacaacgggcaagttggcctatacccggcaaattatgtggaggcgatccagtgatgagtcggggacaggccagcggggggacggaggcggcgggcccaggagcctcagccagccacgtgggcatccactccttttcctgcaagagatgatggttccattgctcttggcttcatggtgttcctggaaggcagatgagctggtcatttcgcctgggactcggcacctttccgagtgcagctggagggatctgagcgcaggaagacgcagaacaacagaaatagccgcccctccccgcccactgtgcctgttggcctatcatagatctctatgttcttgactttgtctctcctttccgagtcaatggtgggttacactgatcttgttccactgattactctctctgacgagtccatcacctgcaacttaaatgaacaagcttacatcccattttgagtgaagattttgaggtttttaatttaaaggctgtgtacagttatacttttttatacacctgttcatttctacttaaattatggcacagattgatgcgcaccagtcttgaggaaacgatctccctattcccttaccctgttactcagccacgccgtgtgtaggcttagcctcaggtggcagatgtttgaggaaaggaattatgccaggaaggtgggaccgggttatggtcgggtttctattgggaatgctctttgtgcttttgggcatctgaatggaagctttacatagaaccttaggtagaactcccccaaatcgccatatttaaaaattattttcactctattcttgcttaaaactgtactcttttgcaaattaacaattttatcactgattcagagttaaaaagaagactaacttttcaagcaaatgcatctgtaaagatgctttagattagactgtcatgtctcagtgtctatctgtatatattatttgatattcagagaatctaaagcactcgtctactgttttaatgagatttaacagcttttaacagtgagtttcgtttgtaaactgcttgaagtctgtggcattcaggcacacgtctggctggccggctgggtctcctcccgggctcagtgggcctggggcctctctgacgtggtgcctgctggagggaggctcgtcgtcaccagctgactgctggtccggcttctgaccggcctttgtcctggctccgtagcagaacactgtaaaagtgcccgcgtctttgcagtagttgcagatttcagtcgtcgtgttacttgtgcacaaacagaagctgggtcttacccgcagcacgagtgtctcgggctgcccggagtcgcccgggagcaggtgctgcagccagagttacgcgggggccacgcgggccggcgggggtggggggaacgtgggggaacctgtgtttcacgtgactcagcagtgcccgccgccgtcaccagctatgcattcactccgtttccagtgagcagatgtcttgcttggaaagtggacctgtgtctgtgtctgtcctgagaacttaccagcagaaatcctcatttctgtgctacggatttaccaaaaattgtcaagtctttttcagtttaacagttcctttacatgtgtagtatttgaggaaaaaaatcaataaacagttgatctcgtgca

SEQ ID NO: 368831 - DNA, 3527 bp, Homo sapiens
gagtcccttgggagaggaaactttctgaaagactgtaggattaccttccctgaacttccggtcaggtgcggtgctgccctgccgcgccctcttacccctggatgccgacgaaaccgcaaaactccagccccgggaagcgcgtctcaaggaccaccaccagcgagcggctttgggagagtgatctgcgccaccctcgcagcccattaaataggcactccccgtttgattgacaggagaagtcaccaatgcgcgtcctggggctttccctcgtcctcacgcggggtgagccgcctctctactcatctggcccaatcgggggcgccggggaggctgtggggcggggctcggtgtccggtagccaatggacagagcccagcgggagcggcgggggcggtgcggtcgcggctggcggcagaagcggccgcaggggtctgggcagggctgggcagtgctgccggagcaaaagcggtagcgggagcccggccggagctgggtctggagacgccgtggcagcctgaacggagtgtgcgacggattgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagcttgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggttcagaagcacctagacctgtccaatgtggctggctacaaagccatttaccatgacctggagcagagcatcagagcagctgatgcagtggaggacctgaggtggttccgagccaatcacgggccaggcatggccatgaactggccgcagtttgaggagtggtccgcagacctgaatcgaaccctcagccggagagagaagaagaaggccactgacggcgtcaccctgacgggcatcaaccagacaggcgaccagtctctgccgagtaagcccagcagcacccttaatgtcccgagcaaccccgcccagtctgcgcagtcacagtccagctacaaccccttcgaggatgaggacgacacgggcagcaccgtcagtgagaaggacgacactaaggccaaaaatgtgagcagctacgagaagacccagagctatcccaccgactggtcagacgatgagtctaacaaccccttctcctccacggatgccaatggggactcgaatccattcgacgacgacgccacctcggggacggaagtgcgagtccgggccctgtatgactatgaggggcaggagcatgatgagctgagcttcaaggctggggatgagctgaccaagatggaggacgaggatgagcagggctggtgcaagggacgcttggacaacgggcaagttggcctatacccggcaaattatgtggaggcgatccagtgatgagtcggggacaggccagcggggggacggaggcggcgggcccaggagcctcagccagccacgtgggcatccactccttttcctgcaagagatgatggttccattgctcttggcttcatggtgttcctggaaggcagatgagctggtcatttcgcctgggactcggcacctttccgagtgcagctggagggatctgagcgcaggaagacgcagaacaacagaaatagccgcccctccccgcccactgtgcctgttggcctatcatagatctctatgttcttgactttgtctctcctttccgagtcaatggtgggttacactgatcttgttccactgattactctctctgacgagtccatcacctgcaacttaaatgaacaagcttacatcccattttgagtgaagattttgaggtttttaatttaaaggctgtgtacagttatacttttttatacacctgttcatttctacttaaattatggcacagattgatgcgcaccagtcttgaggaaacgatctccctattcccttaccctgttactcagccacgccgtgtgtaggcttagcctcaggtggcagatgtttgaggaaaggaattatgccaggaaggtgggaccgggttatggtcgggtttctattgggaatgctctttgtgcttttgggcatctgaatggaagctttacatagaaccttaggtagaactcccccaaatcgccatatttaaaaattattttcactctattcttgcttaaaactgtactcttttgcaaattaacaattttatcactgattcagagttaaaaagaagactaacttttcaagcaaatgcatctgtaaagatgctttagattagactgtcatgtctcagtgtctatctgtatatattatttgatattcagagaatctaaagcactcgtctactgttttaatgagatttaacagcttttaacagtgagtttcgtttgtaaactgcttgaagtctgtggcattcaggcacacgtctggctggccggctgggtctcctcccgggctcagtgggcctggggcctctctgacgtggtgcctgctggagggaggctcgtcgtcaccagctgactgctggtccggcttctgaccggcctttgtcctggctccgtagcagaacactgtaaaagtgcccgcgtctttgcagtagttgcagatttcagtcgtcgtgttacttgtgcacaaacagaagctgggtcttacccgcagcacgagtgtctcgggctgcccggagtcgcccgggagcaggtgctgcagccagagttacgcgggggccacgcgggccggcgggggtggggggaacgtgggggaacctgtgtttcacgtgactcagcagtgcccgccgccgtcaccagctatgcattcactccgtttccagtgagcagatgtcttgcttggaaagtggacctgtgtctgtgtctgtcctgagaacttaccagcagaaatcctcatttctgtgctacggatttaccaaaaattgtcaagtctttttcagtttaacagttcctttacatgtgtagtatttgaggaaaaaaatcaataaacagttgatctcgtgca

SEQ ID NO: 368832 - DNA, 3335 bp, Homo sapiens
cagccccagcccctcagtctgcgtgaggtgcccgtttaggcatcctcagccccaccccttcctgagccagtcagcctcccttcctgacccacagcccagtttctacttggtacccaacctaaagaacattgagaagcccccgttcactgatgtgtatgatcttattaataataaaaatagagaggctcattatctaactacacggagtgcctttcaaactcttggagaggggtgtggtaaacatgaccccaggggcgcatcagggcctggttggcatggaggccatttgtgccacagccaaggacaggctgccccaagccccctgcctcccagctggttctctctcctaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagcttgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggttcagaagcacctagacctgtccaatgtggctggctacaaagccatttaccatgacctggagcagagcatcagagcagctgatgcagtggaggacctgaggtggttccgagccaatcacgggccaggcatggccatgaactggccgcagtttgaggagtggtccgcagacctgaatcgaaccctcagccggagagagaagaagaaggccactgacggcgtcaccctgacgggcatcaaccagacaggcgaccagtctctgccgagtaagcccagcagcacccttaatgtcccgagcaaccccgcccagtctgcgcagtcacagtccagctacaaccccttcgaggatgaggacgacacgggcagcaccgtcagtgagaaggacgacactaaggccaaaaatgtgagcagctacgagaagacccagagctatcccaccgactggtcagacgatgagtctaacaaccccttctcctccacggatgccaatggggactcgaatccattcgacgacgacgccacctcggggacggaagtgcgagtccgggccctgtatgactatgaggggcaggagcatgatgagctgagcttcaaggctggggatgagctgaccaagatggaggacgaggatgagcagggctggtgcaagggacgcttggacaacgggcaagttggcctatacccggcaaattatgtggaggcgatccagtgatgagtcggggacaggccagcggggggacggaggcggcgggcccaggagcctcagccagccacgtgggcatccactccttttcctgcaagagatgatggttccattgctcttggcttcatggtgttcctggaaggcagatgagctggtcatttcgcctgggactcggcacctttccgagtgcagctggagggatctgagcgcaggaagacgcagaacaacagaaatagccgcccctccccgcccactgtgcctgttggcctatcatagatctctatgttcttgactttgtctctcctttccgagtcaatggtgggttacactgatcttgttccactgattactctctctgacgagtccatcacctgcaacttaaatgaacaagcttacatcccattttgagtgaagattttgaggtttttaatttaaaggctgtgtacagttatacttttttatacacctgttcatttctacttaaattatggcacagattgatgcgcaccagtcttgaggaaacgatctccctattcccttaccctgttactcagccacgccgtgtgtaggcttagcctcaggtggcagatgtttgaggaaaggaattatgccaggaaggtgggaccgggttatggtcgggtttctattgggaatgctctttgtgcttttgggcatctgaatggaagctttacatagaaccttaggtagaactcccccaaatcgccatatttaaaaattattttcactctattcttgcttaaaactgtactcttttgcaaattaacaattttatcactgattcagagttaaaaagaagactaacttttcaagcaaatgcatctgtaaagatgctttagattagactgtcatgtctcagtgtctatctgtatatattatttgatattcagagaatctaaagcactcgtctactgttttaatgagatttaacagcttttaacagtgagtttcgtttgtaaactgcttgaagtctgtggcattcaggcacacgtctggctggccggctgggtctcctcccgggctcagtgggcctggggcctctctgacgtggtgcctgctggagggaggctcgtcgtcaccagctgactgctggtccggcttctgaccggcctttgtcctggctccgtagcagaacactgtaaaagtgcccgcgtctttgcagtagttgcagatttcagtcgtcgtgttacttgtgcacaaacagaagctgggtcttacccgcagcacgagtgtctcgggctgcccggagtcgcccgggagcaggtgctgcagccagagttacgcgggggccacgcgggccggcgggggtggggggaacgtgggggaacctgtgtttcacgtgactcagcagtgcccgccgccgtcaccagctatgcattcactccgtttccagtgagcagatgtcttgcttggaaagtggacctgtgtctgtgtctgtcctgagaacttaccagcagaaatcctcatttctgtgctacggatttaccaaaaattgtcaagtctttttcagtttaacagttcctttacatgtgtagtatttgaggaaaaaaatcaataaacagttgatctcgtgca

SEQ ID NO: 368833 - DNA, 4400 bp, Homo sapiens
gagtcccttgggagaggaaactttctgaaagactgtaggattaccttccctgaacttccggtcaggtgcggtgctgccctgccgcgccctcttacccctggatgccgacgaaaccgcaaaactccagccccgggaagcgcgtctcaaggaccaccaccagcgagcggctttgggagagtgatctgcgccaccctcgcagcccattaaataggcactccccgtttgattgacaggagaagtcaccaatgcgcgtcctggggctttccctcgtcctcacgcggggtgagccgcctctctactcatctggcccaatcgggggcgccggggaggctgtggggcggggctcggtgtccggtagccaatggacagagcccagcgggagcggcgggggcggtgcggtcgcggctggcggcagaagcggccgcaggggtctgggcagggctgggcagtgctgccggagcaaaagcggtagcgggagcccggccggagctgggtctggagacgccgtggcagcctgaacggagtgtgcgacggattgggaggtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagcttgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggttcagaagcacctagacctgtccaatgtggctggctacaaagccatttaccatgacctggagcagagcatcagagcagctgatgcagtggaggacctgaggtggttccgagccaatcacgggccaggcatggccatgaactggccgcagtttgaggagtggtccgcagacctgaatcgaaccctcagccggagagagaagaagaaggccactgacggcgtcaccctgacgggcatcaaccagacaggcgaccagtctctgccgagtaagcccagcagcacccttaatgtcccgagcaaccccgcccagtctgcgcagtcacagtccagctacaaccccttcgaggatgaggacgacacgggcagcaccgtcagtgagaaggacgacactaaggccaaaaatgtgagcagctacgagaagacccagagctatcccaccgactggtcagacgatgagtctaacaaccccttctcctccacggatgccaatggggactcgaatccattcgacgacgacgccacctcggggacggaagtgcgagtccgggccctgtatgactatgaggggcaggagcatgatgagctgagcttcaaggctggggatgagctgaccaagatggaggacgaggatgagcagggctggtgcaagggacgcttggacaacgggcaagttggcctatacccggcaaattatgtggaggcgatccagtgatgagtcggggacaggccagcggggggacggaggcggcgggcccaggagcctcagccagccacgtgggcatccactccttttcctgcaagagatgatggttccattgctcttggcttcatggtgttcctggaaggcagatgagctggtcatttcgcctgggactcggcacctttccgagtgcagctggagggatctgagcgcaggaagacgcagaacaacagaaatagccgcccctccccgcccactgtgcctgttggcctatcatagatctctatgttcttgactttgtctctcctttccgagtcaatggtgggttacactgatcttgttccactgattactctctctgacgagtccatcacctgcaacttaaatgaacaagcttacatcccattttgagtgaagattttgaggtttttaatttaaaggctgtgtacagttatacttttttatacacctgttcatttctacttaaattatggcacagattgatgcgcaccagtcttgaggaaacgatctccctattcccttaccctgttactcagccacgccgtgtgtaggcttagcctcaggtggcagatgtttgaggaaaggaattatgccaggaaggtgggaccgggttatggtcgggtttctattgggaatgctctttgtgcttttgggcatctgaatggaagctttacatagaaccttaggtagaactcccccaaatcgccatatttaaaaattattttcactctattcttgcttaaaactgtactcttttgcaaattaacaattttatcactgattcagagttaaaaagaagactaacttttcaagcaaatgcatctgtaaagatgctttagattagactgtcatgtctcagtgtctatctgtatatattatttgatattcagagaatctaaagcactcgtctactgttttaatgagatttaacagcttttaacagtgagtttcgtttgtaaactgcttgaagtctgtggcattcaggcacacgtctggctggccggctgggtctcctcccgggctcagtgggcctggggcctctctgacgtggtgcctgctggagggaggctcgtcgtcaccagctgactgctggtccggcttctgaccggcctttgtcctggctccgtagcagaacactgtaaaagtgcccgcgtctttgcagtagttgcagatttcagtcgtcgtgttacttgtgcacaaacagaagctgggtcttacccgcagcacgagtgtctcgggctgcccggagtcgcccgggagcaggtgctgcagccagagttacgcgggggccacgcgggccggcgggggtggggggaacgtgggggaacctgtgtttcacgtgactcagcagtgcccgccgccgtcaccagctatgcattcactccgtttccagtgagcagatgtcttgcttggaaagtggacctgtgtctgtgtctgtcctgagaacttaccagcagaaatcctcatttctgtgctacggatttaccaaaaattgtcaagtctttttcagtttaacagttcctttacatgtgtagtatttgaggaaaaaaatcaataaacagttgatctcgtgcaaaaaaaccaacgagaaaaaagaagatcagcaaacacacagaacagcgagaagaacgacaccgagccgacagagagaagcacgcgagagggagggagcgacagggcaggagggggtccgcccagcagcgcgccccagcgacgccgcaagacaacgcaggccaggcagagagcgccgagcgacggcgaccgcggaggggcgaccaaacagccagacgcgagacagagcaacgcaccaaagcggagggcgaggcgggcagacacaagcggagacggaccacgccaggccccagagaccagcgcgcagcgccacgacagcgcgagcccgccaccacgcgggaccaggacagcggaggcgccgcgaagacacaaccgaggcggcagaagaaacacaaccagaaagcgacgcagagcgcgagccacctagccgccgaagcacagcaagacacaaccgcaccagccgaccaggccaccggacgccgccgcacccgacagcacacgcgagcgcgcagcacagacgcgcagcacccggacagagaaagaacgagcacgtgcgccggcgcgccggagcagccggacaccgatcgccgaagcggaggcgacgaggccgggcgccgccggcggcaccagcacagcggcgcgagcgagcgctcgcgcgaggcagcgagccggccgcgggcaacggcccgcgggcggcggcggcgcgcgggcggacgggcgagggaggaagacggcaccc

SEQ ID NO: 368834 - DNA, 3610 bp, Homo sapiens
gagtcccttgggagaggaaactttctgaaagactgtaggattaccttccctgaacttccggtcaggtgcggtgctgccctgccgcgccctcttacccctggatgccgacgaaaccgcaaaactccagccccgggaagcgcgtctcaaggaccaccaccagcgagcggctttgggagagtgatctgcgccaccctcgcagcccattaaataggcactccccgtttgattgacaggagaagtcaccaatgcgcgtcctggggctttccctcgtcctcacgcggggtgagccgcctctctactcatctggcccaatcgggggcgccggggaggctgtggggcggggctcggtgtccggtagccaatggacagagcccagcgggagcggcgggggcggtgcggtcgcggctggcggcagaagcggccgcaggggtctgggcagggctgggcagtgctgccggagcaaaagcggtagcgggagcccggccggagctgggtctggagacgccgtggcagcctgaacggagtgtgcgacggattgggaggtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagcttgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggttcagaagcacctagacctgtccaatgtggctggctacaaagccatttaccatgacctggagcagagcatcagagcagctgatgcagtggaggacctgaggtggttccgagccaatcacgggccaggcatggccatgaactggccgcagtttgaggagtggtccgcagacctgaatcgaaccctcagccggagagagaagaagaaggccactgacggcgtcaccctgacgggcatcaaccagacaggcgaccagtctctgccgagtaagcccagcagcacccttaatgtcccgagcaaccccgcccagtctgcgcagtcacagtccagctacaaccccttcgaggatgaggacgacacgggcagcaccgtcagtgagaaggacgacactaaggccaaaaatgtgagcagctacgagaagacccagagctatcccaccgactggtcagacgatgagtctaacaaccccttctcctccacggatgccaatggggactcgaatccattcgacgacgacgccacctcggggacggaagtgcgagtccgggccctgtatgactatgaggggcaggagcatgatgagctgagcttcaaggctggggatgagctgaccaagatggaggacgaggatgagcagggctggtgcaagggacgcttggacaacgggcaagttggcctatacccggcaaattatgtggaggcgatccagtgatgagtcggggacaggccagcggggggacggaggcggcgggcccaggagcctcagccagccacgtgggcatccactccttttcctgcaagagatgatggttccattgctcttggcttcatggtgttcctggaaggcagatgagctggtcatttcgcctgggactcggcacctttccgagtgcagctggagggatctgagcgcaggaagacgcagaacaacagaaatagccgcccctccccgcccactgtgcctgttggcctatcatagatctctatgttcttgactttgtctctcctttccgagtcaatggtgggttacactgatcttgttccactgattactctctctgacgagtccatcacctgcaacttaaatgaacaagcttacatcccattttgagtgaagattttgaggtttttaatttaaaggctgtgtacagttatacttttttatacacctgttcatttctacttaaattatggcacagattgatgcgcaccagtcttgaggaaacgatctccctattcccttaccctgttactcagccacgccgtgtgtaggcttagcctcaggtggcagatgtttgaggaaaggaattatgccaggaaggtgggaccgggttatggtcgggtttctattgggaatgctctttgtgcttttgggcatctgaatggaagctttacatagaaccttaggtagaactcccccaaatcgccatatttaaaaattattttcactctattcttgcttaaaactgtactcttttgcaaattaacaattttatcactgattcagagttactgtcatgtctcagtgtctatctgtatatattatttgatattcagagaatctaaagcactcgtctactgttttaatgagatttaacagcttttaacagtgagtttcgtttgtaaactgcttgaagtctgtggcattcaggcacacgtctggctggccggctgggtctcctcccgggctcagtgggcctggggcctctctgacgtggtgcctgctggagggaggctcgtcgtcaccagctgactgctggtccggcttctgaccggcctttgtcctggctccgtagcagaacactgtaaaagtgcccgcgtctttgcagtagttgcagatttcagtcgtcgtgttacttgtgcacaaacagaagctgggtcttacccgcagcacgagtgtctcgggctgcccggagtcgcccgggagcaggtgctgcagccagagttacgcgggggccacgcgggccggcgggggtggggggaacgtgggggaacctgtgtttcacgtgactcagcagtgcccgccgccgtcaccagctatgcattcactccgtttccagtgagcagatgtcttgcttggaaagtggacctgtgtctgtgtctgtcctgagaacttaccagcagaaatcctcatttctgtgctacggatttaccaaaaattgtcaagtctttttcagtttaacagttcctttacatgtgtagtatttgaggaaaaaaatcaataaacagttgatctcgtgca

SEQ ID NO: 368835 - DNA, 2154 bp, Homo sapiens
gagtcccttgggagaggaaactttctgaaagactgtaggattaccttccctgaacttccggtcaggtgcggtgctgccctgccgcgccctcttacccctggatgccgacgaaaccgcaaaactccagccccgggaagcgcgtctcaaggaccaccaccagcgagcggctttgggagagtgatctgcgccaccctcgcagcccattaaataggcactccccgtttgattgacaggagaagtcaccaatgcgcgtcctggggctttccctcgtcctcacgcggggtgagccgcctctctactcatctggcccaatcgggggcgccggggaggctgtggggcggggctcggtgtccggtagccaatggacagagcccagcgggagcggcgggggcggtgcggtcgcggctggcggcagaagcggccgcaggggtctgggcagggctgggcagtgctgccggagcaaaagcggtagcgggagcccggccggagctgggtctggagacgccgtggcagcctgaacggagtgtgcgacggattgggaggtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagcttgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggttcagaagcacctagacctgtccaatgtggctggctacaaagccatttaccatgacctggagcagagcatcagagcagctgatgcagtggaggacctgaggtggttccgagccaatcacgggccaggcatggccatgaactggccgcagtttgaggagtggtccgcagacctgaatcgaaccctcagccggagagagaagaagaaggccactgacggcgtcaccctgacgggcatcaaccagacaggcgaccagtctctgccgagtaagcccagcagcacccttaatgtcccgagcaaccccgcccagtctgcgcagtcacagtccagctacaaccccttcgaggatgaggacgacacgggcagcaccgtcagtgagaaggacgacactaaggccaaaaatgtgagcagctacgagaagacccagagctatcccaccgactggtcagacgatgagtctaacaaccccttctcctccacggatgccaatggggactcgaatccattcgacgacgacgccacctcggggacggaagtgcgagtccgggccctgtatgactatgaggggcaggagcatgatgagctgagcttcaaggctggggatgagctgaccaagatggaggacgaggatgagcagggctggtgcaagggacgcttggacaacggtgcgttggcccaacgttgggccaacgcaccgtgttgggccagtgggtgacggttctgtggctgagggtgggcgactgtcttccatcatctttttcttgtgaaatattgtacaacacctaa

SEQ ID NO: 368836 - DNA, 1837 bp, Homo sapiens
gagtcccttgggagaggaaactttctgaaagactgtaggattaccttccctgaacttccggtcaggtgcggtgctgccctgccgcgccctcttacccctggatgccgacgaaaccgcaaaactccagccccgggaagcgcgtctcaaggaccaccaccagcgagcggctttgggagagtgatctgcgccaccctcgcagcccattaaataggcactccccgtttgattgacaggagaagtcaccaatgcgcgtcctggggctttccctcgtcctcacgcggggtgagccgcctctctactcatctggcccaatcgggggcgccggggaggctgtggggcggggctcggtgtccggtagccaatggacagagcccagcgggagcggcgggggcggtgcggtcgcggctggcggcagaagcggccgcaggggtctgggcagggctgggcagtgctgccggagcaaaagcggtagcgggagcccggccggagctgggtctggagacgccgtggcagcctgaacggagtgtgcgacggattgggaggtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagcttgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggttcagaagcacctagacctgtccaatgtggctggctacaaagccatttaccatgacctggagcagagcatcagagcagctgatgcagtggaggacctgaggtggttccgagccaatcacgggccaggcatggccatgaactggccgcagtttgaggagtggtccgcagacctgaatcgaaccctcagccggagagagaagaagaaggccactgacggcgtcaccctgacgggcatcaaccagacaggcgaccagtctctgccgagtaagcccagcagcacccttaatgtcccgagcaaccccgcccagtctgcgcagtcacagtccagctacaaccccttcgaggatgaggacgacacgggcagcaccgtcagtgagaaggacgacactaaggccaaaaatgtgagcagctacgagaagacccagagctatccaacccggacctcaatgcaacccggacctcaattt

SEQ ID NO: 368837 - DNA, 480 bp, Homo sapiens
tggagaatgaagggagtcggggactaaacaagtggctgcaggttagttaggacgttgttaaggattaggcaggaggcaatggtggccttagcgaaggtagctatcatcatggggacagagccaagtgggaggattcaagagatattgaagagctgatgtagtccggtcttggaagctgattgaatgtggtagtggtgaggggggttgggtgtgggaagaagaggagtttctggcttgagaagctgggtgaatgaatggtgggaccatttctgacgtagaaaacccaggaacaggagtgggctcatagggaaggggatagtttgcaaggactgtgtgatggccaagtggaggcatccagtaggcagagatgcgggtctgggccagacagcagatcagggggcttgaggttaaaggtggtttggtgtgtgggcacagaagacgtaagagagagggcctgggacagaacctggggagcgccag

SEQ ID NO: 368838 - DNA, 192 bp, Homo sapiens
ccaccgactggtcagacgatgagtctaacaaccccttctcctccacggatgccaatggggactcgaatccattcgacgacgacgccacctcggggacggaagtgcgagtccgggccctgtatgactatgaggggcaggagcatgatgagctgagcttcaaggctggtaggtgggctcccccagcatccaggg

SEQ ID NO: 368839 - DNA, 3664 bp, Homo sapiens
gagtcccttgggagaggaaactttctgaaagactgtaggattaccttccctgaacttccggtcaggtgcggtgctgccctgccgcgccctcttacccctggatgccgacgaaaccgcaaaactccagccccgggaagcgcgtctcaaggaccaccaccagcgagcggctttgggagagtgatctgcgccaccctcgcagcccattaaataggcactccccgtttgattgacaggagaagtcaccaatgcgcgtcctggggctttccctcgtcctcacgcggggtgagccgcctctctactcatctggcccaatcgggggcgccggggaggctgtggggcggggctcggtgtccggtagccaatggacagagcccagcgggagcggcgggggcggtgcggtcgcggctggcggcagaagcggccgcaggggtctgggcagggctgggcagtgctgccggagcaaaagcggtagcgggagcccggccggagctgggtctggagacgccgtggcagcctgaacggagtgtgcgacggattgggaggtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagcttgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggttcagaagcacctagacctgtccaatgtggctggctacaaagccatttaccatgacctggagcagagcatcagagcagctgatgcagtggaggacctgaggtggttccgagccaatcacgggccaggcatggccatgaactggccgcagtttgaggagtggtccgcagacctgaatcgaaccctcagccggagagagaagaagaaggccactgacggcgtcaccctgacgggcatcaaccagacaggcgaccagtctctgccgagtaagcccagcagcacccttaatgtcccgagcaaccccgcccagtctgcgcagtcacagtccagctacaaccccttcgaggatgaggacgacacgggcagcaccgtcagtgagaaggacgacactaaggccaaaaatgtgagcagctacgagaagacccagagctatcccaccgactggtcagacgatgagtctaacaaccccttctcctccacggatgccaatggggactcgaatccattcgacgacgacgccacctcggggacggaagtgcgagtccgggccctgtatgactatgaggggcaggagcatgatgagctgagcttcaaggctggggatgagctgaccaagatggaggacgaggatgagcagggctggtgcaagggacgcttggacaacgggcaagttggcctatacccggcaaattatgtggaggcgatccagtgatgagtcggggacaggccagcggggggacggaggcggcgggcccaggagcctcagccagccacgtgggcatccactccttttcctgcaagagatgatggttccattgctcttggcttcatggtgttcctggaaggcagatgagctggtcatttcgcctgggactcggcacctttccgagtgcagctggagggatctgagcgcaggaagacgcagaacaacagaaatagccgcccctccccgcccactgtgcctgttggcctatcatagatctctatgttcttgactttgtctctcctttccgagtcaatggtgggttacactgatcttgttccactgattactctctctgacgagtccatcacctgcaacttaaatgaacaagcttacatcccattttgagtgaagattttgaggtttttaatttaaaggctgtgtacagttatacttttttatacacctgttcatttctacttaaattatggcacagattgatgcgcaccagtcttgaggaaacgatctccctattcccttaccctgttactcagccacgccgtgtgtaggcttagcctcaggtggcagatgtttgaggaaaggaattatgccaggaaggtgggaccgggttatggtcgggtttctattgggaatgctctttgtgcttttgggcatctgaatggaagctttacatagaaccttaggtagaactcccccaaatcgccatatttaaaaattattttcactctattcttgcttaaaactgtactcttttgcaaattaacaattttatcactgattcagagttaaaaagaagactaacttttcaagcaaatgcatctgtaaagatgctttagattagactgtcatgtctcagtgtctatctgtatatattatttgatattcagagaatctaaagcactcgtctactgttttaatgagatttaacagcttttaacagtgagtttcgtttgtaaactgcttgaagtctgtggcattcaggcacacgtctggctggccggctgggtctcctcccgggctcagtgggcctggggcctctctgacgtggtgcctgctggagggaggctcgtcgtcaccagctgactgctggtccggcttctgaccggcctttgtcctggctccgtagcagaacactgtaaaagtgcccgcgtctttgcagtagttgcagatttcagtcgtcgtgttacttgtgcacaaacagaagctgggtcttacccgcagcacgagtgtctcgggctgcccggagtcgcccgggagcaggtgctgcagccagagttacgcgggggccacgcgggccggcgggggtggggggaacgtgggggaacctgtgtttcacgtgactcagcagtgcccgccgccgtcaccagctatgcattcactccgtttccagtgagcagatgtcttgcttggaaagtggacctgtgtctgtgtctgtcctgagaacttaccagcagaaatcctcatttctgtgctacggatttaccaaaaattgtcaagtctttttcagtttaacagttcctttacatgtgtagtatttgaggaaaaaaatcaataaacagttgatctcgtgca

SEQ ID NO: 368840 - DNA, 735 bp, Homo sapiens
cttggtggtgggctcaaggaacagagccccggacttgcatggtcctcgccacccccgctgtcctctgggaggtgggcagcatggcctgggggtggttgtagaggtgcaagcctccagatcccctgatgagcccctgctttgaacagtgaggaggggctcaggtcgtttgggttcataagtggggcatggggagcctgaggtcttctgggaaaccagggagagctggggccctgagtctacacatcagatgcacagagccaactgcaggctcgctgggcaggaactgaggacagacgtggcttccagcaagtagtgaacctttggtttctctccctcggcacctgttgcctaggagtggtccgcagacctgaatcgaaccctcagccggagagagaagaagaaggccactgacggcgtcaccctgacgggcatcaaccagacaggcgaccagtctctgccgagtaagcccagcaggtgagtgggcgccacctccatccaaaagaggccgttccatggtgggggccctgggcaatctgcatggtccagggcagccccggcctggacacctgggaggttcctgggctcctgagctctgtggccgtggcccagcctggacacctgggaggttcctgggctcttgagctctgtggccgtggcccaggggcatctccagggaaggtcgtcttcctgcctggtgccagagctgctgacagatccagagagggaggcttggcc

SEQ ID NO: 368841 - DNA, 3263 bp, Homo sapiens
tgggagaattcagctgagagacagaggtcagacatgccagcagggttggaaagaggcaggtacggaagctgagctgcagagttagccggcatctgacagaaaaatgtgagtgtgctgtggaaggcttgcatttcctttaaggtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagcttgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggttcagaagcacctagacctgtccaatgtggctggctacaaagccatttaccatgacctggagcagagcatcagagcagctgatgcagtggaggacctgaggtggttccgagccaatcacgggccaggcatggccatgaactggccgcagtttgaggagtggtccgcagacctgaatcgaaccctcagccggagagagaagaagaaggccactgacggcgtcaccctgacgggcatcaaccagacaggcgaccagtctctgccgagtaagcccagcagcacccttaatgtcccgagcaaccccgcccagtctgcgcagtcacagtccagctacaaccccttcgaggatgaggacgacacgggcagcaccgtcagtgagaaggacgacactaaggccaaaaatgtgagcagctacgagaagacccagagctatcccaccgactggtcagacgatgagtctaacaaccccttctcctccacggatgccaatggggactcgaatccattcgacgacgacgccacctcggggacggaagtgcgagtccgggccctgtatgactatgaggggcaggagcatgatgagctgagcttcaaggctggggatgagctgaccaagatggaggacgaggatgagcagggctggtgcaagggacgcttggacaacgggcaagttggcctatacccggcaaattatgtggaggcgatccagtgatgagtcggggacaggccagcggggggacggaggcggcgggcccaggagcctcagccagccacgtgggcatccactccttttcctgcaagagatgatggttccattgctcttggcttcatggtgttcctggaaggcagatgagctggtcatttcgcctgggactcggcacctttccgagtgcagctggagggatctgagcgcaggaagacgcagaacaacagaaatagccgcccctccccgcccactgtgcctgttggcctatcatagatctctatgttcttgactttgtctctcctttccgagtcaatggtgggttacactgatcttgttccactgattactctctctgacgagtccatcacctgcaacttaaatgaacaagcttacatcccattttgagtgaagattttgaggtttttaatttaaaggctgtgtacagttatacttttttatacacctgttcatttctacttaaattatggcacagattgatgcgcaccagtcttgaggaaacgatctccctattcccttaccctgttactcagccacgccgtgtgtaggcttagcctcaggtggcagatgtttgaggaaaggaattatgccaggaaggtgggaccgggttatggtcgggtttctattgggaatgctctttgtgcttttgggcatctgaatggaagctttacatagaaccttaggtagaactcccccaaatcgccatatttaaaaattattttcactctattcttgcttaaaactgtactcttttgcaaattaacaattttatcactgattcagagttaaaaagaagactaacttttcaagcaaatgcatctgtaaagatgctttagattagactgtcatgtctcagtgtctatctgtatatattatttgatattcagagaatctaaagcactcgtctactgttttaatgagatttaacagcttttaacagtgagtttcgtttgtaaactgcttgaagtctgtggcattcaggcacacgtctggctggccggctgggtctcctcccgggctcagtgggcctggggcctctctgacgtggtgcctgctggagggaggctcgtcgtcaccagctgactgctggtccggcttctgaccggcctttgtcctggctccgtagcagaacactgtaaaagtgcccgcgtctttgcagtagttgcagatttcagtcgtcgtgttacttgtgcacaaacagaagctgggtcttacccgcagcacgagtgtctcgggctgcccggagtcgcccgggagcaggtgctgcagccagagttacgcgggggccacgcgggccggcgggggtggggggaacgtgggggaacctgtgtttcacgtgactcagcagtgcccgccgccgtcaccagctatgcattcactccgtttccagtgagcagatgtcttgcttggaaagtggacctgtgtctgtgtctgtcctgagaacttaccagcagaaatcctcatttctgtgctacggatttaccaaaaattgtcaagtctttttcagtttaacagttcctttacatgtgtagtatttgaggaaaaaaatcaataaacagttgatctcgtgca

SEQ ID NO: 368842 - DNA, 3454 bp, Homo sapiens
tgggagaattcagctgagagacagaggtcagacatgccagcagggttggaaagaggcaggtacggaagctgagctgcagagttagccggcatctgacagaaaaatgtgagtgtgctgtggaaggcttgcatttcctttaaggtagacctctttgaaagtagaattttcacggaattgttttctttctcactgagtgactgatttaacagaactctcaccttctatgcaagcgcacctagttttagagctccgtgacggcaatgttcaattagttcattattaactgagcaatgcagaatgctttatccagggtgcttggagaagatgtcagagtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagcttgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggttcagaagcacctagacctgtccaatgtggctggctacaaagccatttaccatgacctggagcagagcatcagagcagctgatgcagtggaggacctgaggtggttccgagccaatcacgggccaggcatggccatgaactggccgcagtttgaggagtggtccgcagacctgaatcgaaccctcagccggagagagaagaagaaggccactgacggcgtcaccctgacgggcatcaaccagacaggcgaccagtctctgccgagtaagcccagcagcacccttaatgtcccgagcaaccccgcccagtctgcgcagtcacagtccagctacaaccccttcgaggatgaggacgacacgggcagcaccgtcagtgagaaggacgacactaaggccaaaaatgtgagcagctacgagaagacccagagctatcccaccgactggtcagacgatgagtctaacaaccccttctcctccacggatgccaatggggactcgaatccattcgacgacgacgccacctcggggacggaagtgcgagtccgggccctgtatgactatgaggggcaggagcatgatgagctgagcttcaaggctggggatgagctgaccaagatggaggacgaggatgagcagggctggtgcaagggacgcttggacaacgggcaagttggcctatacccggcaaattatgtggaggcgatccagtgatgagtcggggacaggccagcggggggacggaggcggcgggcccaggagcctcagccagccacgtgggcatccactccttttcctgcaagagatgatggttccattgctcttggcttcatggtgttcctggaaggcagatgagctggtcatttcgcctgggactcggcacctttccgagtgcagctggagggatctgagcgcaggaagacgcagaacaacagaaatagccgcccctccccgcccactgtgcctgttggcctatcatagatctctatgttcttgactttgtctctcctttccgagtcaatggtgggttacactgatcttgttccactgattactctctctgacgagtccatcacctgcaacttaaatgaacaagcttacatcccattttgagtgaagattttgaggtttttaatttaaaggctgtgtacagttatacttttttatacacctgttcatttctacttaaattatggcacagattgatgcgcaccagtcttgaggaaacgatctccctattcccttaccctgttactcagccacgccgtgtgtaggcttagcctcaggtggcagatgtttgaggaaaggaattatgccaggaaggtgggaccgggttatggtcgggtttctattgggaatgctctttgtgcttttgggcatctgaatggaagctttacatagaaccttaggtagaactcccccaaatcgccatatttaaaaattattttcactctattcttgcttaaaactgtactcttttgcaaattaacaattttatcactgattcagagttaaaaagaagactaacttttcaagcaaatgcatctgtaaagatgctttagattagactgtcatgtctcagtgtctatctgtatatattatttgatattcagagaatctaaagcactcgtctactgttttaatgagatttaacagcttttaacagtgagtttcgtttgtaaactgcttgaagtctgtggcattcaggcacacgtctggctggccggctgggtctcctcccgggctcagtgggcctggggcctctctgacgtggtgcctgctggagggaggctcgtcgtcaccagctgactgctggtccggcttctgaccggcctttgtcctggctccgtagcagaacactgtaaaagtgcccgcgtctttgcagtagttgcagatttcagtcgtcgtgttacttgtgcacaaacagaagctgggtcttacccgcagcacgagtgtctcgggctgcccggagtcgcccgggagcaggtgctgcagccagagttacgcgggggccacgcgggccggcgggggtggggggaacgtgggggaacctgtgtttcacgtgactcagcagtgcccgccgccgtcaccagctatgcattcactccgtttccagtgagcagatgtcttgcttggaaagtggacctgtgtctgtgtctgtcctgagaacttaccagcagaaatcctcatttctgtgctacggatttaccaaaaattgtcaagtctttttcagtttaacagttcctttacatgtgtagtatttgaggaaaaaaatcaataaacagttgatctcgtgca

SEQ ID NO: 368843 - DNA, 3241 bp, Homo sapiens
aaggaacgctgttttagaaaatccttactacttgatgattaatccttggagctaatgttccacgttcccaaggttgtgagtgcttatggccacattcctgcatcagctcagccatcgcggtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagcttgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggttcagaagcacctagacctgtccaatgtggctggctacaaagccatttaccatgacctggagcagagcatcagagcagctgatgcagtggaggacctgaggtggttccgagccaatcacgggccaggcatggccatgaactggccgcagtttgaggagtggtccgcagacctgaatcgaaccctcagccggagagagaagaagaaggccactgacggcgtcaccctgacgggcatcaaccagacaggcgaccagtctctgccgagtaagcccagcagcacccttaatgtcccgagcaaccccgcccagtctgcgcagtcacagtccagctacaaccccttcgaggatgaggacgacacgggcagcaccgtcagtgagaaggacgacactaaggccaaaaatgtgagcagctacgagaagacccagagctatcccaccgactggtcagacgatgagtctaacaaccccttctcctccacggatgccaatggggactcgaatccattcgacgacgacgccacctcggggacggaagtgcgagtccgggccctgtatgactatgaggggcaggagcatgatgagctgagcttcaaggctggggatgagctgaccaagatggaggacgaggatgagcagggctggtgcaagggacgcttggacaacgggcaagttggcctatacccggcaaattatgtggaggcgatccagtgatgagtcggggacaggccagcggggggacggaggcggcgggcccaggagcctcagccagccacgtgggcatccactccttttcctgcaagagatgatggttccattgctcttggcttcatggtgttcctggaaggcagatgagctggtcatttcgcctgggactcggcacctttccgagtgcagctggagggatctgagcgcaggaagacgcagaacaacagaaatagccgcccctccccgcccactgtgcctgttggcctatcatagatctctatgttcttgactttgtctctcctttccgagtcaatggtgggttacactgatcttgttccactgattactctctctgacgagtccatcacctgcaacttaaatgaacaagcttacatcccattttgagtgaagattttgaggtttttaatttaaaggctgtgtacagttatacttttttatacacctgttcatttctacttaaattatggcacagattgatgcgcaccagtcttgaggaaacgatctccctattcccttaccctgttactcagccacgccgtgtgtaggcttagcctcaggtggcagatgtttgaggaaaggaattatgccaggaaggtgggaccgggttatggtcgggtttctattgggaatgctctttgtgcttttgggcatctgaatggaagctttacatagaaccttaggtagaactcccccaaatcgccatatttaaaaattattttcactctattcttgcttaaaactgtactcttttgcaaattaacaattttatcactgattcagagttaaaaagaagactaacttttcaagcaaatgcatctgtaaagatgctttagattagactgtcatgtctcagtgtctatctgtatatattatttgatattcagagaatctaaagcactcgtctactgttttaatgagatttaacagcttttaacagtgagtttcgtttgtaaactgcttgaagtctgtggcattcaggcacacgtctggctggccggctgggtctcctcccgggctcagtgggcctggggcctctctgacgtggtgcctgctggagggaggctcgtcgtcaccagctgactgctggtccggcttctgaccggcctttgtcctggctccgtagcagaacactgtaaaagtgcccgcgtctttgcagtagttgcagatttcagtcgtcgtgttacttgtgcacaaacagaagctgggtcttacccgcagcacgagtgtctcgggctgcccggagtcgcccgggagcaggtgctgcagccagagttacgcgggggccacgcgggccggcgggggtggggggaacgtgggggaacctgtgtttcacgtgactcagcagtgcccgccgccgtcaccagctatgcattcactccgtttccagtgagcagatgtcttgcttggaaagtggacctgtgtctgtgtctgtcctgagaacttaccagcagaaatcctcatttctgtgctacggatttaccaaaaattgtcaagtctttttcagtttaacagttcctttacatgtgtagtatttgaggaaaaaaatcaataaacagttgatctcgtgca

SEQ ID NO: 368844 - DNA, 3329 bp, Homo sapiens
agaaacaagcggtacgcggcgatgcccgtgctcaggagactggtgtactgtgcaagagcgccgtgaggcagacctaggtagagcgtgcagttgttgccgagcgtggatcttggggacggatatgtgtactagcaagagtttccgatgccgttcgatggcttgaccccgcatagaatctaagggtagtaacatttgttgctagactcctcctccaggatcctgtgtgataatagagagtcgtcgtggttcgagcaatagttgatgtatgtccgcttgggtagtagtaaagttgctcccaagacgatcggtcctatcttggtgtaggtcggtgcgatatctatactaacgtcggtgacatggtgacagctgagtatctgacggatggccaccgcctgtgcagcgacctcatgaactgcctgcatgagcgggcgcgcatcgagaaggcgtatgcgcagcagctcactgagtgggcccggcgctggaggcagcttgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggttcagaagcacctagacctgtccaatgtggctggctacaaagccatttaccatgacctggagcagagcatcagagcagctgatgcagtggaggacctgaggtggttccgagccaatcacgggccaggcatggccatgaactggccgcagtttgaggagtggtccgcagacctgaatcgaaccctcagccggagagagaagaagaaggccactgacggcgtcaccctgacgggcatcaaccagacaggcgaccagtctctgccgagtaagcccagcagcacccttaatgtcccgagcaaccccgcccagtctgcgcagtcacagtccagctacaaccccttcgaggatgaggacgacacgggcagcaccgtcagtgagaaggacgacactaaggccaaaaatgtgagcagctacgagaagacccagagctatcccaccgactggtcagacgatgagtctaacaaccccttctcctccacggatgccaatggggactcgaatccattcgacgacgacgccacctcggggacggaagtgcgagtccgggccctgtatgactatgaggggcaggagcatgatgagctgagcttcaaggctggggatgagctgaccaagatggaggacgaggatgagcagggctggtgcaagggacgcttggacaacgggcaagttggcctatacccggcaaattatgtggaggcgatccagtgatgagtcggggacaggccagcggggggacggaggcggcgggcccaggagcctcagccagccacgtgggcatccactccttttcctgcaagagatgatggttccattgctcttggcttcatggtgttcctggaaggcagatgagctggtcatttcgcctgggactcggcacctttccgagtgcagctggagggatctgagcgcaggaagacgcagaacaacagaaatagccgcccctccccgcccactgtgcctgttggcctatcatagatctctatgttcttgactttgtctctcctttccgagtcaatggtgggttacactgatcttgttccactgattactctctctgacgagtccatcacctgcaacttaaatgaacaagcttacatcccattttgagtgaagattttgaggtttttaatttaaaggctgtgtacagttatacttttttatacacctgttcatttctacttaaattatggcacagattgatgcgcaccagtcttgaggaaacgatctccctattcccttaccctgttactcagccacgccgtgtgtaggcttagcctcaggtggcagatgtttgaggaaaggaattatgccaggaaggtgggaccgggttatggtcgggtttctattgggaatgctctttgtgcttttgggcatctgaatggaagctttacatagaaccttaggtagaactcccccaaatcgccatatttaaaaattattttcactctattcttgcttaaaactgtactcttttgcaaattaacaattttatcactgattcagagttaaaaagaagactaacttttcaagcaaatgcatctgtaaagatgctttagattagactgtcatgtctcagtgtctatctgtatatattatttgatattcagagaatctaaagcactcgtctactgttttaatgagatttaacagcttttaacagtgagtttcgtttgtaaactgcttgaagtctgtggcattcaggcacacgtctggctggccggctgggtctcctcccgggctcagtgggcctggggcctctctgacgtggtgcctgctggagggaggctcgtcgtcaccagctgactgctggtccggcttctgaccggcctttgtcctggctccgtagcagaacactgtaaaagtgcccgcgtctttgcagtagttgcagatttcagtcgtcgtgttacttgtgcacaaacagaagctgggtcttacccgcagcacgagtgtctcgggctgcccggagtcgcccgggagcaggtgctgcagccagagttacgcgggggccacgcgggccggcgggggtggggggaacgtgggggaacctgtgtttcacgtgactcagcagtgcccgccgccgtcaccagctatgcattcactccgtttccagtgagcagatgtcttgcttggaaagtggacctgtgtctgtgtctgtcctgagaacttaccagcagaaatcctcatttctgtgctacggatttaccaaaaattgtcaagtctttttcagtttaacagttcctttacatgtgtagtatttgaggaaaaaaatcaataaacagttgatctcgtgca

SEQ ID NO: 368845 - DNA, 2368 bp, Homo sapiens
cttggtggtgggctcaaggaacagagccccggacttgcatggtcctcgccacccccgctgtcctctgggaggtgggcagcatggcctgggggtggttgtagaggtgcaagcctccagatcccctgatgagcccctgctttgaacagtgaggaggggctcaggtcgtttgggttcataagtggggcatggggagcctgaggtcttctgggaaaccagggagagctggggccctgagtctacacatcagatgcacagagccaactgcaggctcgctgggcaggaactgaggacagacgtggcttccagcaagtagtgaacctttggtttctctccctcggcacctgttgcctaggagtggtccgcagacctgaatcgaaccctcagccggagagagaagaagaaggccactgacggcgtcaccctgacgggcatcaaccagacaggcgaccagtctctgccgagtaagcccagcagtgtgagcagctacgagaagacccagagctatcccaccgactggtcagacgatgagtctaacaaccccttctcctccacggatgccaatggggactcgaatccattcgacgacgacgccacctcggggacggaagtgcgagtccgggccctgtatgactatgaggggcaggagcatgatgagctgagcttcaaggctggggatgagctgaccaagatggaggacgaggatgagcagggctggtgcaagggacgcttggacaacgggcaagttggcctatacccggcaaattatgtggaggcgatccagtgatgagtcggggacaggccagcggggggacggaggcggcgggcccaggagcctcagccagccacgtgggcatccactccttttcctgcaagagatgatggttccattgctcttggcttcatggtgttcctggaaggcagatgagctggtcatttcgcctgggactcggcacctttccgagtgcagctggagggatctgagcgcaggaagacgcagaacaacagaaatagccgcccctccccgcccactgtgcctgttggcctatcatagatctctatgttcttgactttgtctctcctttccgagtcaatggtgggttacactgatcttgttccactgattactctctctgacgagtccatcacctgcaacttaaatgaacaagcttacatcccattttgagtgaagattttgaggtttttaatttaaaggctgtgtacagttatacttttttatacacctgttcatttctacttaaattatggcacagattgatgcgcaccagtcttgaggaaacgatctccctattcccttaccctgttactcagccacgccgtgtgtaggcttagcctcaggtggcagatgtttgaggaaaggaattatgccaggaaggtgggaccgggttatggtcgggtttctattgggaatgctctttgtgcttttgggcatctgaatggaagctttacatagaaccttaggtagaactcccccaaatcgccatatttaaaaattattttcactctattcttgcttaaaactgtactcttttgcaaattaacaattttatcactgattcagagttaaaaagaagactaacttttcaagcaaatgcatctgtaaagatgctttagattagactgtcatgtctcagtgtctatctgtatatattatttgatattcagagaatctaaagcactcgtctactgttttaatgagatttaacagcttttaacagtgagtttcgtttgtaaactgcttgaagtctgtggcattcaggcacacgtctggctggccggctgggtctcctcccgggctcagtgggcctggggcctctctgacgtggtgcctgctggagggaggctcgtcgtcaccagctgactgctggtccggcttctgaccggcctttgtcctggctccgtagcagaacactgtaaaagtgcccgcgtctttgcagtagttgcagatttcagtcgtcgtgttacttgtgcacaaacagaagctgggtcttacccgcagcacgagtgtctcgggctgcccggagtcgcccgggagcaggtgctgcagccagagttacgcgggggccacgcgggccggcgggggtggggggaacgtgggggaacctgtgtttcacgtgactcagcagtgcccgccgccgtcaccagctatgcattcactccgtttccagtgagcagatgtcttgcttggaaagtggacctgtgtctgtgtctgtcctgagaacttaccagcagaaatcctcatttctgtgctacggatttaccaaaaattgtcaagtctttttcagtttaacagttcctttacatgtgtagtatttgaggaaaaaaatcaataaacagttgatctcgtgca

SEQ ID NO: 368846 - DNA, 2090 bp, Homo sapiens
gagtcccttgggagaggaaactttctgaaagactgtaggattaccttccctgaacttccggtcaggtgcggtgctgccctgccgcgccctcttacccctggatgccgacgaaaccgcaaaactccagccccgggaagcgcgtctcaaggaccaccaccagcgagcggctttgggagagtgatctgcgccaccctcgcagcccattaaataggcactccccgtttgattgacaggagaagtcaccaatgcgcgtcctggggctttccctcgtcctcacgcggggtgagccgcctctctactcatctggcccaatcgggggcgccggggaggctgtggggcggggctcggtgtccggtagccaatggacagagcccagcgggagcggcgggggcggtgcggtcgcggctggcggcagaagcggccgcaggggtctgggcagggctgggcagtgctgccggagcaaaagcggtagcgggagcccggccggagctgggtctggagacgccgtggcagcctgaacggagtgtgcgacggattgggaggtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagcttgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggttcagaagcacctagacctgtccaatgtggctggctacaaagccatttaccatgacctggagcagagcatcagagcagctgatgcagtggaggacctgaggtggttccgagccaatcacgggccaggcatggccatgaactggccgcagtttgaggagtggtccgcagacctgaatcgaaccctcagccggagagagaagaagaaggccactgacggcgtcaccctgacgggcatcaaccagacaggcgaccagtctctgccgagtaagcccagcagcacccttaatgtcccgagcaaccccgcccagtctgcgcagtcacagtccagctacaaccccttcgaggatgaggacgacacgggcagcaccgtcagtgagaaggacgacactaaggccaaaaatgtgagcagctacgagaagacccagagctatcccaccgactggtcagacgatgagtctaacaaccccttctcctccacggatgccaatggggactcgaatccattcgacgacgacgccacctcggggacggaagtgcgagtccgggccctgtatgactatgaggggcaggagcatgatgagctgagcttcaaggctggggatgagctgaccaagatggaggaacgaggctgacacaggtctgccagctcaggacgctgggacaccacggccagggccaagcgtggagcgcacgcaagccggactggagcaggaggcccac

SEQ ID NO: 368847 - DNA, 732 bp, Homo sapiens
attaataagattaccaacagcgtgttaattacaaagaacagtgaggagctagaggtggacgacccccggaaaccgaactgctttgaactttacatccccaacaacaaggggcagctcatcaaagcctgcaaaactgaggcggacggccgagtggtggagggaaaccacatggtgtaccggatctcggcccccacgcaggaggagaaggacgagtggatcaagtccatccaggcggctgtgagtgtggaccccttctatgagatgctggcagcgagaaagaagcggatttcagtcaagaagaagcaggagcagccctgaccccctgcccccaactccattatttattacggagctgccccgcctgggtggccggacccctgggccttggggctgtggatcctggttccctgtttggaaaattcaccacctctagctcctcactgttctttgtaattaacacgctgttggtaatcttattaattatttaaccacttggcctgctgaccccctcatttcttggggttgacagagtcgaggtgctccgtggagccagcctgtttccctggacaggggcctggacccgcctgtctctgggtgctgcctgggctgtcccggtgggtctgttctggtttcaccccgagcccagcaggagtggagtaaagggagaaggttaatatggtgggagtctggagttggaattggccggggacagagtttagaatgcagggattc

SEQ ID NO: 368848 - DNA, 539 bp, Homo sapiens
  misc_feature (111)..(111): n is a, c, g, or t
ttgatcactcgaccttctcatcctgcgtagagggccgagatccggtacaccatgtagtatccctccaccactcggacgtccgcctcagttatgcaggctttgatgagctgncccttgttgttggggatgtaaagttcaaagcagttcggtttccgggggtcgtccaaacagggaaccaggacccctgggccttggggctgtggatcctggttccctgtttggaaaattcaccacctctagctcctcactgttctttgtaattaacacgctgttggtaatcttattaattatttaaccacttggcctgctgaccccctcatttcttggggttgacagagtcgaggtgctccgtggagccagcctgtttccctggacaggggcctggacccgcctgtctctgggtgctgcctgggctgtcccggtgggtctgttctggtttcaccccgagcccagcaggagtggagtaaagggagaaggttaatatggtgggagtctggagttggaattggccggggacagagtttagaatgcagggattc

SEQ ID NO: 368849 - DNA, 681 bp, Homo sapiens
ctgcccctgcgcacccctccctgtgcccaccctgtttctgtcgcctgcggctcttgggggtgctccattctcccgccttcccttctcctgcacctggtcctgcctgctttctcgctgtctgccccaggagggggccgggtgaagacgtggaagcggcgctggtttatcctcacagacaactgcctctactactttgagtacaccacggacaaggagccccgaggaatcatccccctggagaatctgagcatccgagaggtggacgacccccggaaaccgaactccattatttattacggagctgccccgcctgggtggccggacccctgggccttggggctgtggatcctggttccctgtttggaaaattcaccacctctagctcctcactgttctttgtaattaacacgctgttggtaatcttattaattatttaaccacttggcctgctgaccccctcatttcttggggttgacagagtcgaggtgctccgtggagccagcctgtttccctggacaggggcctggacccgcctgtctctgggtgctgcctgggctgtcccggtgggtctgttctggtttcaccccgagcccagcaggagtggagtaaagggagaaggttaatatggtgggagtctggagttggaattggccggggacagagtttagaatgcagggattc

SEQ ID NO: 368850 - DNA, 1827 bp, Homo sapiens
gcagaggtggctgtaccgcgtggctccgcctccgcgcgacacttttccggggcttctcattggagagcaagcctgtcaagtgctttctgttgtttcggaggcggggcctgctgccctgcctgcactccgattggccccgcgggccgtctacctctggccggacatacctacaccggctttttgtacgactgttggccctggagaacgatcctttggtggcgagggcggggaggacgaaagcgcccactgtggattggacagtgtcaaaaagaggggcggtccctactgaaggggcggttgggcgacgaagggaagagtcttttcagcgctgaggactggcgctgaggaggcggcggtggctcccggggcgtttgagcgggctcacccgagcccgcgggccaacgcggatccaggcccgactggcgggaccgccccggattccccgcgggccttcctagccgccatggaggacggcgtctatgaacccccagacctgactccggaggagcggatggagctggagaacatccggcggcggaagcaggagctgctggtggagattcagcgcctgcgggaggagctcagtgaagccatgagcgaggtggaggggctggaggccaatgagggcagtaagaccttgcaacggaaccggaagatggcaatgggcaggaagaagttcaacatggaccccaagaaggggatccagttcttggtggagaatgaactgctgcagaacacacccgaggagatcgcccgcttcctgtacaagggcgaggggctgaacaagacagccatcggggactacctgggggagagggaagaactgaacctggcagtgctccatgcttttgtggatctgcatgagttcaccgacctcaatctggtgcaggccctcaggcagtttctatggagctttcgcctacccggagaggcccagaaaattgaccggatgatggaggccttcgcccagcgatactgcctgtgcaaccctggggttttccagtccacagacacgtgctatgtgctgtccttcgccgtcatcatgctcaacaccagtctccacaatcccaatgtccgggacaagccgggcctggagcgctttgtggccatgaaccggggcatcaacgagggcggggacctgcctgaggagctgctcaggaacctgtacgacagcatccgaaatgagcccttcaagattcctgaggatgacgggaatgacctgacccacaccttcttcaacccggaccgggagggctggctcctgaagctgggagggggccgggtgaagacgtggaagcggcgctggtttatcctcacagacaactgcctctactactttgagtacaccacggacaaggagccccgaggaatcatccccctggagaatctgagcatccgagaggtggacgacccccggaaaccgaactgctttgaactttacatccccaacaacaaggggcagctcatcaaagcctgcaaaactgaggcggacggccgagtggtggagggaaaccacatggtgtaccggatctcggcccccacgcaggaggagaaggacgagtggatcaagtccatccaggcggctgtgagtgtggaccccttctatgagatgctggcagcgagaaagaagcggatttcagtcaagaagaagcaggagcagccctgaccccctgcccccaactccattatttattacggagctgccccgcctgggtggccggacccctgggccttggggctgtggatcctggttccctgtttggaaaattcaccacctctagctcctcactgttctttgtaattaacacgctgttggtaatcttatta

SEQ ID NO: 368851 - DNA, 2042 bp, Homo sapiens
gcagaggtggctgtaccgcgtggctccgcctccgcgcgacacttttccggggcttctcattggagagcaagcctgtcaagtgctttctgttgtttcggaggcggggcctgctgccctgcctgcactccgattggccccgcgggccgtctacctctggccggacatacctacaccggctttttgtacgactgttggccctggagaacgatcctttggtggcgagggcggggaggacgaaagcgcccactgtggattggacagtgtcaaaaagaggggcggtccctactgaaggggcggttgggcgacgaagggaagagtcttttcagcgctgaggactggcgctgaggaggcggcggtggctcccggggcgtttgagcgggctcacccgagcccgcgggccaacgcggatccaggcccgactggcgggaccgccccggattccccgcgggccttcctagccgccatggaggacggcgtctatgaacccccagacctgactccggaggagcggatggagctggagaacatccggcggcggaagcaggagctgctggtggagattcagcgcctgcgggaggagctcagtgaagccatgagcgaggtggaggggctggaggccaatgagggcagtaagaccttgcaacggaaccggaagatggcaatgggcaggaagaagttcaacatggaccccaagaaggggatccagttcttggtggagaatgaactgctgcagaacacacccgaggagatcgcccgcttcctgtacaagggcgaggggctgaacaagacagccatcggggactacctgggggagagggaagaactgaacctggcagtgctccatgcttttgtggatctgcatgagttcaccgacctcaatctggtgcaggccctcaggcagtttctatggagctttcgcctacccggagaggcccagaaaattgaccggatgatggaggccttcgcccagcgatactgcctgtgcaaccctggggttttccagtccacagacacgtgctatgtgctgtccttcgccgtcatcatgctcaacaccagtctccacaatcccaatgtccgggacaagccgggcctggagcgctttgtggccatgaaccggggcatcaacgagggcggggacctgcctgaggagctgctcaggaacctgtacgacagcatccgaaatgagcccttcaagattcctgaggatgacgggaatgacctgacccacaccttcttcaacccggaccgggagggctggctcctgaagctgggagggggccgggtgaagacgtggaagcggcgctggtttatcctcacagacaactgcctctactactttgagtacaccacggacaaggagccccgaggaatcatccccctggagaatctgagcatccgagaggtggacgacccccggaaaccgaactgctttgaactttacatccccaacaacaaggggcagctcatcaaagcctgcaaaactgaggcggacggccgagtggtggagggaaaccacatggtgtaccggatctcggcccccggcggctgtgagtgtggaccccttctatgagatgctggcagcgagaaagaagcggatttcagtcaagaagaagcaggagcagccctgaccccctgcccccaactccattatttattacggagctgccccgcctgggtggccggacccctgggccttggggctgtggatcctggttccctgtttggaaaattcaccacctctagctcctcactgttctttgtaattaacacgctgttggtaatcttattaattatttaaccacttggcctgctgaccccctcatttcttggggttgacagagtcgaggtgctccgtggagccagcctgtttccctggacaggggcctggacccgcctgtctctgggtgctgcctgggctgtcccggtgggtctgttctggtttcaccccgagcccagcaggagtggagtaaagggagaaggttaatatggtgggagtctggagttggaattggccggggacagagtttagaatgcagggattc

SEQ ID NO: 368852 - DNA, 2002 bp, Homo sapiens
gcagaggtggctgtaccgcgtggctccgcctccgcgcgacacttttccggggcttctcattggagagcaagcctgtcaagtgctttctgttgtttcggaggcggggcctgctgccctgcctgcactccgattggccccgcgggccgtctacctctggccggacatacctacaccggctttttgtacgactgttggccctggagaacgatcctttggtggcgagggcggggaggacgaaagcgcccactgtggattggacagtgtcaaaaagaggggcggtccctactgaaggggcggttgggcgacgaagggaagagtcttttcagcgctgaggactggcgctgaggaggcggcggtggctcccggggcgtttgagcgggctcacccgagcccgcgggccaacgcggatccaggcccgactggcgggaccgccccggattccccgcgggccttcctagccgccatggaggacggcgtctatgaacccccagacctgactccggaggagcggatggagctggagaacatccggcggcggaagcaggagctgctggtggagattcagcgcctgcgggaggagctcagtgaagccatgagcgaggtggaggggctggaggccaatgagggcagtaagaccttgcaacggaaccggaagatggcaatgggcaggaagaagttcaacatggaccccaagaaggggatccagttcttggtggagaatgaactgctgcagaacacacccgaggagatcgcccgcttcctgtacaagggcgaggggctgaacaagacagccatcggggactacctgggggagagggaagaactgaacctggcagtgctccatgcttttgtggatctgcatgagttcaccgacctcaatctggtgcaggccctcaggcagtttctatggagctttcgcctacccggagaggcccagaaaattgaccggatgatggaggccttcgcccagcgatactgcctgtgcaaccctggggttttccagtccacagacacgtgctatgtgctgtccttcgccgtcatcatgctcaacaccagtctccacaatcccaatgtccgggacaagccgggcctggagcgctttgtggccatgaaccggggcatcaacgagggcggggacctgcctgaggagctgctcaggaacctgtacgacagcatccgaaatgagcccttcaagattcctgaggatgacgggaatgacctgacccacaccttcttcaacccggaccgggagggctggctcctgaagctgggagggggccgggtgaagacgtggaagcggcgctggtttatcctcacagacaactgcctctactactttgagtacaccacggacaaggagccccgaggaatcatccccctggagaatctgagcatccgagaggtggacgacccccggaaaccgaactgctttgaactttacatccccaacaacaaggggcagacgcaggaggagaaggacgagtggatcaagtccatccaggcggctgtgagtgtggaccccttctatgagatgctggcagcgagaaagaagcggatttcagtcaagaagaagcaggagcagccctgaccccctgcccccaactccattatttattacggagctgccccgcctgggtggccggacccctgggccttggggctgtggatcctggttccctgtttggaaaattcaccacctctagctcctcactgttctttgtaattaacacgctgttggtaatcttattaattatttaaccacttggcctgctgaccccctcatttcttggggttgacagagtcgaggtgctccgtggagccagcctgtttccctggacaggggcctggacccgcctgtctctgggtgctgcctgggctgtcccggtgggtctgttctggtttcaccccgagcccagcaggagtggagtaaagggagaaggttaatatggtgggagtctggagttggaattggccggggacagagtttagaatgcagggattc

SEQ ID NO: 368853 - DNA, 1511 bp, Homo sapiens
tttctcccaactgtacaaaggtctggcctaagcagggttcccaagccagatattcctcccaagagtgtgttctgagcatcccccaccctgggggcaggcctgtgtgggagtccagcaggaaacttcaccctcggcagtgggcagctgtggtgcagtagagggggcacgacttccccagggcattgccctttgcccattcctgccccatcctttccaaactgtatgtgtctttgtcccatccttccagggaagaactgaacctggcagtgctccatgcttttgtggatctgcatgagttcaccgacctcaatctggtgcaggccctcaggcagtttctatggagctttcgcctacccggagaggcccagaaaattgaccggatgatggaggccttcgcccagcgatactgcctgtgcaaccctggggttttccagtccacagacacgtgctatgtgctgtccttcgccgtcatcatgctcaacaccagtctccacaatcccaatgtccgggacaagccgggcctggagcgctttgtggccatgaaccggggcatcaacgagggcggggacctgcctgaggagctgctcaggaacctgtacgacagcatccgaaatgagcccttcaagattcctgaggatgacgggaatgacctgacccacaccttcttcaacccggaccgggagggctggctcctgaagctgggagggggccgggtgaagacgtggaagcggcgctggtttatcctcacagacaactgcctctactactttgagtacaccacggacaaggagccccgaggaatcatccccctggagaatctgagcatccgagaggtggacgacccccggaaaccgaactgctttgaactttacatccccaacaacaaggggcagctcatcaaagcctgcaaaactgaggcggacggccgagtggtggagggaaaccacatggtgtaccggatctcggcccccacgcaggaggagaaggacgagtggatcaagtccatccaggcggctgtgagtgtggaccccttctatgagatgctggcagcgagaaagaagcggatttcagtcaagaagaagcaggagcagccctgaccccctgcccccaactccattatttattacggagctgccccgcctgggtggccggacccctgggccttggggctgtggatcctggttccctgtttggaaaattcaccacctctagctcctcactgttctttgtaattaacacgctgttggtaatcttattaattatttaaccacttggcctgctgaccccctcatttcttggggttgacagagtcgaggtgctccgtggagccagcctgtttccctggacaggggcctggacccgcctgtctctgggtgctgcctgggctgtcccggtgggtctgttctggtttcaccccgagcccagcaggagtggagtaaagggagaaggttaatatggtgggagtctggagttggaattggccggggacagagtttagaatgcagggattc

SEQ ID NO: 368854 - DNA, 932 bp, Homo sapiens
cattctgggcgtcatgctgtggggataatggcgatctcctcgcacacgcgcttgttcgtgtggaagtcgttgcccaggcgcgtgtagtacttttctatgatgaccccccccggatgcatgcaggggggggccgggtgaagacgtggaagcggcgctggtttatcctcacagacaactgcctctactactttgagtacaccacggacaaggagccccgaggaatcatccccctggagaatctgagcatccgagaggtggacgacccccggaaaccgaactgctttgaactttacatccccaacaacaaggggcagctcatcaaagcctgcaaaactgaggcggacggccgagtggtggagggaaaccacatggtgtaccggatctcggcccccacgcaggaggagaaggacgagtggatcaagtccatccaggcggctgtgagtgtggaccccttctatgagatgctggcagcgagaaagaagcggatttcagtcaagaagaagcaggagcagccctgaccccctgcccccaactccattatttattacggagctgccccgcctgggtggccggacccctgggccttggggctgtggatcctggttccctgtttggaaaattcaccacctctagctcctcactgttctttgtaattaacacgctgttggtaatcttattaattatttaaccacttggcctgctgaccccctcatttcttggggttgacagagtcgaggtgctccgtggagccagcctgtttccctggacaggggcctggacccgcctgtctctgggtgctgcctgggctgtcccggtgggtctgttctggtttcaccccgagcccagcaggagtggagtaaagggagaaggttaatatggtgggagtctggagttggaattggccggggacagagtttagaatgcagggattc

SEQ ID NO: 368855 - DNA, 963 bp, Homo sapiens
agaggcatctcacctgaagtaccatcgagcacggcatcgtcaccaactgggacgacatggagaaaatctggcaccacaccttctacaatgagctgcgtgtggctcccggacagcaccccgtgctgctgaccgaggcccccctcctcctctgtgctgtggggccgggtgaagacgtggaagcggcgctggtttatcctcacagacaactgcctctactactttgagtacaccacggacaaggagccccgaggaatcatccccctggagaatctgagcatccgagaggtggacgacccccggaaaccgaactgctttgaactttacatccccaacaacaaggggcagctcatcaaagcctgcaaaactgaggcggacggccgagtggtggagggaaaccacatggtgtaccggatctcggcccccacgcaggaggagaaggacgagtggatcaagtccatccaggcggctgtgagtgtggaccccttctatgagatgctggcagcgagaaagaagcggatttcagtcaagaagaagcaggagcagccctgaccccctgcccccaactccattatttattacggagctgccccgcctgggtggccggacccctgggccttggggctgtggatcctggttccctgtttggaaaattcaccacctctagctcctcactgttctttgtaattaacacgctgttggtaatcttattaattatttaaccacttggcctgctgaccccctcatttcttggggttgacagagtcgaggtgctccgtggagccagcctgtttccctggacaggggcctggacccgcctgtctctgggtgctgcctgggctgtcccggtgggtctgttctggtttcaccccgagcccagcaggagtggagtaaagggagaaggttaatatggtgggagtctggagttggaattggccggggacagagtttagaatgcagggattc

SEQ ID NO: 368856 - DNA, 1105 bp, Homo sapiens
gcagaggtggctgtaccgcgtggctccgcctccgcgcgacacttttccggggcttctcattggagagcaagcctgtcaagtgctttctgttgtttcggaggcggggcctgctgccctgcctgcactccgattggccccgcgggccgtctacctctggccggacatacctacaccggctttttgtacgactgttggccctggagaacgatcctttggtggcgagggcggggaggacgaaagcgcccactgtggattggacagtgtcaaaaagaggggcggtccctactgaaggggcggttgggcgacgaagggaagagtcttttcagcgctgaggactggcgctgaggaggcggcggtggctcccggggcgtttgagcgggctcacccgagcccgcgggccaacgcggatccaggcccgactggcgggaccgccccggattccccgcgggccttcctagccgccatggaggacggcgtctatgaacccccagacctgactccggaggagcggatggagctggagaacatccggcggcggaagcaggagctgctggtggagattcagcgcctgcgggaggagctcagtgaagccatgagcgaggtggaggggctggaggccaatgagggcagtaagaccttgcaacggaaccggaagatggcaatgggcaggaagaagcaggagcagccctgaccccctgcccccaactccattatttattacggagctgccccgcctgggtggccggacccctgggccttggggctgtggatcctggttccctgtttggaaaattcaccacctctagctcctcactgttctttgtaattaacacgctgttggtaatcttattaattatttaaccacttggcctgctgaccccctcatttcttggggttgacagagtcgaggtgctccgtggagccagcctgtttccctggacaggggcctggacccgcctgtctctgggtgctgcctgggctgtcccggtgggtctgttctggtttcaccccgagcccagcaggagtggagtaaagggagaaggttaatatggtgggagtctggagttggaattggccggggacagagtttagaatgcagggattc

SEQ ID NO: 368857 - DNA, 598 bp, Homo sapiens
gcagaggtggctgtaccgcgtggctccgcctccgcgcgacacttttccggggcttctcattggagagcaagcctgtcaagtgctttctgttgtttcggaggcggggcctgctgccctgcctgcactccgattggccccgcgggccgtctacctctggccggacatacctacaccggctttttgtacgactgttggccctggagaacgatcctttggtggcgagggcggggaggacgaaagcgcccactgtggattggacagtgtcaaaaagaggggcggtccctactgaaggggcggttgggcgacgaagggaagagtcttttcagcgctgaggactggcgctgaggaggcggcggtggctcccggggcgtttgagcgggctcacccgagcccgcgggccaacgcggatccaggcccgactggcggggaacccgcccccggtaattccgcggcgctctacgcagagaggttatacccaacgatcgagacgatgatgaaatcggggacagacgtgtgaatcagctgggagactcgacagacagtgagctggcaagcaactgagacgaagagggaatcaagacaaggacctggataggaa

SEQ ID NO: 368858 - DNA, 783 bp, Homo sapiens
  misc_feature (63)..(63): n is a, c, g, or t
  misc_feature (72)..(72): n is a, c, g, or t
  misc_feature (95)..(95): n is a, c, g, or t
tggcctttttaattaactttgggagtaacaaccacgggacaaagggagccccgggagggattnaattccccnttgggaggaatttggagcattcnggaggaggtggaggaacccccgggaaaccggaactgctttgaactttacatccccaacaacaaggggcagctcatcaaagcctgcaaaactgaggcggacggccgagtggtggagggaaaccacatggtgtaccggatctcggcccccacgcaggaggagaaggacgagtggatcaagtccatccaggcggctgtgagtgtggaccccttctatgagatgctggcagcgagaaagaagcggatttcagtcaagaagaagcaggagcagccctgaccccctgcccccaactccattatttattacggagctgccccgcctgggtggccggacccctgggccttggggctgtggatcctggttccctgtttggaaaattcaccacctctagctcctcactgttctttgtaattaacacgctgttggtaatcttattaattatttaaccacttggcctgctgaccccctcatttcttggggttgacagagtcgaggtgctccgtggagccagcctgtttccctggacaggggcctggacccgcctgtctctgggtgctgcctgggctgtcccggtgggtctgttctggtttcaccccgagcccagcaggagtggagtaaagggagaaggttaatatggtgggagtctggagttggaattggccggggacagagtttagaatgcagggattc

SEQ ID NO: 368859 - DNA, 479 bp, Homo sapiens
attaataagattaccaacagcgtgttaattacaaagaacagtgaggagctagaggtggacgacccccggaaaccgaactgctttgaactttacatccccaacaacaaggggcagctcatcaaagcctgcaaaactgaggcggacggccgagtggtggagggaaaccacatggtgtaccggatctcggcccccacgcaggaggagaaggacgagtggatcaagtccatccaggcggctgtgagtgtggaccccttctatgagatgctggcagcgagaaagaagcggatttcagtcaagaagaagcaggagcagccctgaccccctgcccccaactccattatttattacggagctgccccgcctgggtggccggacccctgggccttggggctgtggatcctggttccctgtttggaaaattcaccacctctagctcctcactgttctttgtaattaacacgctgttggtaatcttatta

SEQ ID NO: 368860 - DNA, 2080 bp, Homo sapiens
gcagaggtggctgtaccgcgtggctccgcctccgcgcgacacttttccggggcttctcattggagagcaagcctgtcaagtgctttctgttgtttcggaggcggggcctgctgccctgcctgcactccgattggccccgcgggccgtctacctctggccggacatacctacaccggctttttgtacgactgttggccctggagaacgatcctttggtggcgagggcggggaggacgaaagcgcccactgtggattggacagtgtcaaaaagaggggcggtccctactgaaggggcggttgggcgacgaagggaagagtcttttcagcgctgaggactggcgctgaggaggcggcggtggctcccggggcgtttgagcgggctcacccgagcccgcgggccaacgcggatccaggcccgactggcgggaccgccccggattccccgcgggccttcctagccgccatggaggacggcgtctatgaacccccagacctgactccggaggagcggatggagctggagaacatccggcggcggaagcaggagctgctggtggagattcagcgcctgcgggaggagctcagtgaagccatgagcgaggtggaggggctggaggccaatgagggcagtaagaccttgcaacggaaccggaagatggcaatgggcaggaagaagttcaacatggaccccaagaaggggatccagttcttggtggagaatgaactgctgcagaacacacccgaggagatcgcccgcttcctgtacaagggcgaggggctgaacaagacagccatcggggactacctgggggagagggaagaactgaacctggcagtgctccatgcttttgtggatctgcatgagttcaccgacctcaatctggtgcaggccctcaggcagtttctatggagctttcgcctacccggagaggcccagaaaattgaccggatgatggaggccttcgcccagcgatactgcctgtgcaaccctggggttttccagtccacagacacgtgctatgtgctgtccttcgccgtcatcatgctcaacaccagtctccacaatcccaatgtccgggacaagccgggcctggagcgctttgtggccatgaaccggggcatcaacgagggcggggacctgcctgaggagctgctcaggaacctgtacgacagcatccgaaatgagcccttcaagattcctgaggatgacgggaatgacctgacccacaccttcttcaacccggaccgggagggctggctcctgaagctgggagggggccgggtgaagacgtggaagcggcgctggtttatcctcacagacaactgcctctactactttgagtacaccacggacaaggagccccgaggaatcatccccctggagaatctgagcatccgagaggtggacgacccccggaaaccgaactgctttgaactttacatccccaacaacaaggggcagctcatcaaagcctgcaaaactgaggcggacggccgagtggtggagggaaaccacatggtgtaccggatctcggcccccacgcaggaggagaaggacgagtggatcaagtccatccaggcggctgtgagtgtggaccccttctatgagatgctggcagcgagaaagaagcggatttcagtcaagaagaagcaggagcagccctgaccccctgcccccaactccattatttattacggagctgccccgcctgggtggccggacccctgggccttggggctgtggatcctggttccctgtttggaaaattcaccacctctagctcctcactgttctttgtaattaacacgctgttggtaatcttattaattatttaaccacttggcctgctgaccccctcatttcttggggttgacagagtcgaggtgctccgtggagccagcctgtttccctggacaggggcctggacccgcctgtctctgggtgctgcctgggctgtcccggtgggtctgttctggtttcaccccgagcccagcaggagtggagtaaagggagaaggttaatatggtgggagtctggagttggaattggccggggacagagtttagaatgcagggattc

SEQ ID NO: 368861 - DNA, 1869 bp, Homo sapiens
ggcgaggccggggcggaaccattcccgctggaggggcgggcgagcccagcgcctgccggggccggggaggggcgcttgggttgcggggaggggagaaatcttggggggcgggggccttcgatgtcccgccccaccttcccaactctcctgagctgtcatcagttcccccggctgtagtgacttttcatggacccagtagtccggataaccaggtccccagctacctcgccagtaatggagtcagaaaaccaaggcctcagtccccttccaaaacccccagacctgactccggaggagcggatggagctggagaacatccggcggcggaagcaggagctgctggtggagattcagcgcctgcgggaggagctcagtgaagccatgagcgaggtggaggggctggaggccaatgagggcagtaagaccttgcaacggaaccggaagatggcaatgggcaggaagaagttcaacatggaccccaagaaggggatccagttcttggtggagaatgaactgctgcagaacacacccgaggagatcgcccgcttcctgtacaagggcgaggggctgaacaagacagccatcggggactacctgggggagagggaagaactgaacctggcagtgctccatgcttttgtggatctgcatgagttcaccgacctcaatctggtgcaggccctcaggcagtttctatggagctttcgcctacccggagaggcccagaaaattgaccggatgatggaggccttcgcccagcgatactgcctgtgcaaccctggggttttccagtccacagacacgtgctatgtgctgtccttcgccgtcatcatgctcaacaccagtctccacaatcccaatgtccgggacaagccgggcctggagcgctttgtggccatgaaccggggcatcaacgagggcggggacctgcctgaggagctgctcaggaacctgtacgacagcatccgaaatgagcccttcaagattcctgaggatgacgggaatgacctgacccacaccttcttcaacccggaccgggagggctggctcctgaagctgggagggggccgggtgaagacgtggaagcggcgctggtttatcctcacagacaactgcctctactactttgagtacaccacggacaaggagccccgaggaatcatccccctggagaatctgagcatccgagaggtggacgacccccggaaaccgaactgctttgaactttacatccccaacaacaaggggcagctcatcaaagcctgcaaaactgaggcggacggccgagtggtggagggaaaccacatggtgtaccggatctcggcccccacgcaggaggagaaggacgagtggatcaagtccatccaggcggctgtgagtgtggaccccttctatgagatgctggcagcgagaaagaagcggatttcagtcaagaagaagcaggagcagccctgaccccctgcccccaactccattatttattacggagctgccccgcctgggtggccggacccctgggccttggggctgtggatcctggttccctgtttggaaaattcaccacctctagctcctcactgttctttgtaattaacacgctgttggtaatcttattaattatttaaccacttggcctgctgaccccctcatttcttggggttgacagagtcgaggtgctccgtggagccagcctgtttccctggacaggggcctggacccgcctgtctctgggtgctgcctgggctgtcccggtgggtctgttctggtttcaccccgagcccagcaggagtggagtaaagggagaaggttaatatggtgggagtctggagttggaattggccggggacagagtttagaatgcagggattc

SEQ ID NO: 368862 - DNA, 1719 bp, Homo sapiens
gtccattaccaaagcctggaagttctcatcacctccaggtggactgcttggcagtgctaggaggtggactcaggacttcagaagcaacatttctggcctgacctggaaggtgaaggtgaagaacccccagacctgactccggaggagcggatggagctggagaacatccggcggcggaagcaggagctgctggtggagattcagcgcctgcgggaggagctcagtgaagccatgagcgaggtggaggggctggaggccaatgagggcagtaagaccttgcaacggaaccggaagatggcaatgggcaggaagaagttcaacatggaccccaagaaggggatccagttcttggtggagaatgaactgctgcagaacacacccgaggagatcgcccgcttcctgtacaagggcgaggggctgaacaagacagccatcggggactacctgggggagagggaagaactgaacctggcagtgctccatgcttttgtggatctgcatgagttcaccgacctcaatctggtgcaggccctcaggcagtttctatggagctttcgcctacccggagaggcccagaaaattgaccggatgatggaggccttcgcccagcgatactgcctgtgcaaccctggggttttccagtccacagacacgtgctatgtgctgtccttcgccgtcatcatgctcaacaccagtctccacaatcccaatgtccgggacaagccgggcctggagcgctttgtggccatgaaccggggcatcaacgagggcggggacctgcctgaggagctgctcaggaacctgtacgacagcatccgaaatgagcccttcaagattcctgaggatgacgggaatgacctgacccacaccttcttcaacccggaccgggagggctggctcctgaagctgggagggggccgggtgaagacgtggaagcggcgctggtttatcctcacagacaactgcctctactactttgagtacaccacggacaaggagccccgaggaatcatccccctggagaatctgagcatccgagaggtggacgacccccggaaaccgaactgctttgaactttacatccccaacaacaaggggcagctcatcaaagcctgcaaaactgaggcggacggccgagtggtggagggaaaccacatggtgtaccggatctcggcccccacgcaggaggagaaggacgagtggatcaagtccatccaggcggctgtgagtgtggaccccttctatgagatgctggcagcgagaaagaagcggatttcagtcaagaagaagcaggagcagccctgaccccctgcccccaactccattatttattacggagctgccccgcctgggtggccggacccctgggccttggggctgtggatcctggttccctgtttggaaaattcaccacctctagctcctcactgttctttgtaattaacacgctgttggtaatcttattaattatttaaccacttggcctgctgaccccctcatttcttggggttgacagagtcgaggtgctccgtggagccagcctgtttccctggacaggggcctggacccgcctgtctctgggtgctgcctgggctgtcccggtgggtctgttctggtttcaccccgagcccagcaggagtggagtaaagggagaaggttaatatggtgggagtctggagttggaattggccggggacagagtttagaatgcagggattc

SEQ ID NO: 368863 - DNA, 1666 bp, Homo sapiens
gcagaggtggctgtaccgcgtggctccgcctccgcgcgacacttttccggggcttctcattggagagcaagcctgtcaagtgctttctgttgtttcggaggcggggcctgctgccctgcctgcactccgattggccccgcgggccgtctacctctggccggacatacctacaccggctttttgtacgactgttggccctggagaacgatcctttggtggcgagggcggggaggacgaaagcgcccactgtggattggacagtgtcaaaaagaggggcggtccctactgaaggggcggttgggcgacgaagggaagagtcttttcagcgctgaggactggcgctgaggaggcggcggtggctcccggggcgtttgagcgggctcacccgagcccgcgggccaacgcggatccaggcccgactggcgggaccgccccggattccccgcgggccttcctagccgccatggaggacggcgtctatgaacccccagacctgactccggaggagcggatggagctggagaacatccggcggcggaagcaggagctgctggtggagattcagcgcctgcgggaggagctcagtgaagccatgagcgaggtggaggggctggaggccaatgagggcagtaagaccttgcaacggaaccggaagatggcaatgggcaggaagaagttcaacatggaccccaagaaggggatccagttcttggtggagaatgaactgctgcagaacacacccgaggagatcgcccgcttcctgtacaagggcgaggggctgaacaagacagccatcggggactacctgggggagagggaagaactgaacctggcagtgctccatgcttttgtggatctgcatgagttcaccgacctcaatctggtgcaggccctcaggcagtttctatggagctttcgcctacccggagaggcccagaaaattgaccggatgatggaggccttcgcccagcgatactgcctgtgcaaccctggggttttccagtccacagacacgtgctatgtgctgtccttcgccgtcatcatgctcaacaccagtctccacaatcccaatgtccgggacaagccgggcctggagcgctttgtggccatgaaccggggcatcaacgagggcggggacctgcctgaggagctgctcaggaacctgtacgacagcatccgaaatgagcccttcaagattcctgaggatgacgggaatgacctgacccacaccttcttgcaggagcagccctgaccccctgcccccaactccattatttattacggagctgccccgcctgggtggccggacccctgggccttggggctgtggatcctggttccctgtttggaaaattcaccacctctagctcctcactgttctttgtaattaacacgctgttggtaatcttattaattatttaaccacttggcctgctgaccccctcatttcttggggttgacagagtcgaggtgctccgtggagccagcctgtttccctggacaggggcctggacccgcctgtctctgggtgctgcctgggctgtcccggtgggtctgttctggtttcaccccgagcccagcaggagtggagtaaagggagaaggttaatatggtgggagtctggagttggaattggccggggacagagtttagaatgcagggattc

SEQ ID NO: 368864 - DNA, 980 bp, Homo sapiens
ctgcccctgcgcacccctccctgtgcccaccctgtttctgtcgcctgcggctcttgggggtgctccattctcccgccttcccttctcctgcacctggtcctgcctgctttctcgctgtctgccccaggaggtaggtacacgacctgtctttgtctcccaccccttccctttcagggggccgggtgaagacgtggaagcggcgctggtttatcctcacagacaactgcctctactactttgagtacaccacggacaaggagccccgaggaatcatccccctggagaatctgagcatccgagaggtggacgacccccggaaaccgaactgctttgaactttacatccccaacaacaaggggcagctcatcaaagcctgcaaaactgaggcggacggccgagtggtggagggaaaccacatggtgtaccggatctcggcccccacgcaggaggagaaggacgagtggatcaagtccatccaggcggctgtgagtgtggaccccttctatgagatgctggcagcgagaaagaagcggatttcagtcaagaagaagcaggagcagccctgaccccctgcccccaactccattatttattacggagctgccccgcctgggtggccggacccctgggccttggggctgtggatcctggttccctgtttggaaaattcaccacctctagctcctcactgttctttgtaattaacacgctgttggtaatcttattaattatttaaccacttggcctgctgaccccctcatttcttggggttgacagagtcgaggtgctccgtggagccagcctgtttccctggacaggggcctggacccgcctgtctctgggtgctgcctgggctgtcccggtgggtctgttctggtttcaccccgagcccagcaggagtggagtaaagggagaaggttaatatggtgggagtctggagttggaattggccggggacagagtttagaatgcagggattc

SEQ ID NO: 368865 - DNA, 1032 bp, Homo sapiens
gcagaggtggctgtaccgcgtggctccgcctccgcgcgacacttttccggggcttctcattggagagcaagcctgtcaagtgctttctgttgtttcggaggcggggcctgctgccctgcctgcactccgattggccccgcgggccgtctacctctggccggacatacctacaccggctttttgtacgactgttggccctggagaacgatcctttggtggcgagggcggggaggacgaaagcgcccactgtggattggacagtgtcaaaaagaggggcggtccctactgaaggggcggttgggcgacgaagggaagagtcttttcagcgctgaggactggcgctgaggaggcggcggtggctcccggggcgtttgagcgggctcacccgagcccgcgggccaacgcggatccaggcccgactggcgggaccgccccggattccccgcgggccttcctagccgccatggaggacggcgtctatgaacccccagacctgactccggaggagcggatggagctggagaacatccggcggcggaagcaggagctgctggtggagattcagcgcctgcgggaggagctcagtgaagccatgagcgaggtggaggggctggaggccaatgagggcagtaagaccttgcaacggaaccggaagatggcaatgggcaggaagaagttcaacatggaccccaagaaggggatccagttcttggtggagaatgaactgctgcagaacacacccgaggagatcgcccgcttcctgtacaagggcgaggggctgaacaagacagccatcggggactacctgggggagagggaagaactgaacctggcagtgctccatgcttttgtggatctgcatgagttcaccgacctcaatctggtgcaggccctcagggattcacaacactcccgtggccaatgcccattggtgagactggatcatgtgaccatacctgaaacaactgctgaggccggaaggtcgggattcctcgtggaccagttcctaacacagggactgagagtggggac

SEQ ID NO: 368866 - DNA, 815 bp, Homo sapiens
ggacactaggctaggtacgaggctggtgttaatcggccgaggcgactcactttagtcctgtgggacggcccaggtggcaggatgtcctggtctggccttctccatggcctcaacacgtccctaacttgtggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccactcatggattcaagtcctggctccgcctcttccatcaggaccactattaagccataggagtcctgggggtgcaaagggtgcccctctgtcaacacccttggctcctgtgtttagaggggtggcctgaaggaccttttctgctgggacaagacactgtactgccctctgctgggaaggggttttaataaacagaccctggcgcttgtgatgt

SEQ ID NO: 368867 - DNA, 1220 bp, Homo sapiens
ggacactaggctaggtacgaggctggtgttaatcggccgaggcgactcactttagtcctgtgggacggcccaggtggcaggatgtcctggtctggccttctccatggcctcaacacgtccctaacttgtggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccactcatggattcaagtcctggctccgcctcttccatcaggaccactattaagccataggagtcctgggggtgcaaagggtgcccctctgtcaacacccttggctcctgtgtttagaggggtggcctgaaggaccttttctgctgggacaagacactgtactgccctctgctgggaaggggttttaataaacagaccctggcgcttgtgatgtcaaaaaaacaaaaaaaaaaaaaaaaaaaaaaaaaaaaaaaaaaaaacggggggcttttttgggggggggggaaaaaagggtttattaagggggggtgggcaagggttgttcgggacccttttttttggacagggggggaaacgggggggggccccaaaaggggggggcggtaaaatttgggaaaagccgcggttttccttcttatgttttcttcggaaacaggaaatgtagacactgacatcaactataaacaacataagcagtagatgttcaaaatatcacagtagtatgaagtacacaataagacagaaatcagagacaagagatacactaaataattacttatcataacaacaatgttaattcataaattcaagaacagaataagacgaacacaaagaaaat

SEQ ID NO: 368868 - DNA, 264 bp, Homo sapiens
gcggccgcctactactactactgctcgaattcaagcttctaacgatgtacgggctcatggattcaagtcctggctccgcctcttccatcaggaccactattaagccataggagtcctgggggtgcaaagggtgcccctctgtcaacacccttggctcctgtgtttagaggggtggcctgaaggaccttttctgctgggacaagacactgtactgccctctgctgggaaggggttttaataaacagaccctggcgcttgtgatgt

SEQ ID NO: 368869 - DNA, 1185 bp, Homo sapiens
tgagggagtgcgctgtagccctcgcgcgcatactcgtacaggaggttccggtttcgtttctctgtagtgaaacttctccttggactatcgttggagatgcagcctccccggggccggaacccccgacgagtcagcaaaggccacaagcgccgcgccatggacgcagccatcttggaccggggacaaggcggcacttcgtcccgcccactccgcgtttagaccaattgcaaggcagcgaacctgaccgtgacgagccaatcagatcctgaggaaagttgaccgcgatagagtccttcgtcgcccaatcgtcgtctgtgtcccgcctcttcagtgacgcgaggcagaaccagccaatccctgcacggatagcgcccggaagaggctagaagctggattcagcgtgtccgcgacctcacctttaggtcctgtgagggacggcccaggtggcaggatgtcctggtctggccttctccatggcctcaacacgtccctaacttgtggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccactcatggattcaagtcctggctccgcctcttccatcaggaccactattaagccataggagtcctgggggtgcaaagggtgcccctctgtcaacacccttggctcctgtgtttagaggggtggcctgaaggaccttttctgctgggacaagacactgtactgccctctgctgggaaggggttttaataaacagaccctggcgcttgtgatgt

SEQ ID NO: 368870 - DNA, 1358 bp, Homo sapiens
tgagggagtgcgctgtagccctcgcgcgcatactcgtacaggaggttccggtttcgtttctctgtagtgaaacttctccttggactatcgttggagatgcagcctccccggggccggaacccccgacgagtcagcaaaggccacaagcgccgcgccatggacgcagccatcttggaccggggacaaggcggcacttcgtcccgcccactccgcgtttagaccaattgcaaggcagcgaacctgaccgtgacgagccaatcagatcctgaggaaagttgaccgcgatagagtccttcgtcgcccaatcgtcgtctgtgtcccgcctcttcagtgacgcgaggcagaaccagccaatccctgcacggatagcgcccggaagaggctagaagctggattcagcgtgtccgcgacctcacctttaggtcctgtgaggtcggtggaatcctggggtcctccaaatctaccaggccatctccccagtttcccagttcttcctgcgtgcgggcgagagtggttgggccctcgggaacccactcagagcgaggctaaatttacggagggactttctgttagcagcatgagggcctgtggttagacctatagagggacggcccaggtggcaggatgtcctggtctggccttctccatggcctcaacacgtccctaacttgtggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccactcatggattcaagtcctggctccgcctcttccatcaggaccactattaagccataggagtcctgggggtgcaaagggtgcccctctgtcaacacccttggctcctgtgtttagaggggtggcctgaaggaccttttctgctgggacaagacactgtactgccctctgctgggaaggggttttaataaacagaccctggcgcttgtgatgt

SEQ ID NO: 368871 - DNA, 1497 bp, Homo sapiens
tgagggagtgcgctgtagccctcgcgcgcatactcgtacaggaggttccggtttcgtttctctgtagtgaaacttctccttggactatcgttggagatgcagcctccccggggccggaacccccgacgagtcagcaaaggccacaagcgccgcgccatggacgcagccatcttggaccggggacaaggcggcacttcgtcccgcccactccgcgtttagaccaattgcaaggcagcgaacctgaccgtgacgagccaatcagatcctgaggaaagttgaccgcgatagagtccttcgtcgcccaatcgtcgtctgtgtcccgcctcttcagtgacgcgaggcagaaccagccaatccctgcacggatagcgcccggaagaggctagaagctggattcagcgtgtccgcgacctcacctttaggtcctgtgaggtcggtggaatcctggggtcctccaaatctaccaggccatctccccagtttcccagttcttcctgcgtgcgggcgagagtggttgggccctcgggaacccactcagagcgaggctaaatttacggagggactttctgttagcagcatgagggcctgtggttagacctatagagggacggcccaggtggcaggatgtcctggtctggccttctccatggcctcaacacgtccctaacttgtggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccactcatggattcaagtcctggctccgcctcttccatcaggaccactattaagccataggagtcctgggggtgcaaagggtgcccctctgtcaacacccttggctcctgtgtttagaggggtggcctgaaggaccttttctgctgggacaagacactgtactgccctctgctgggaaggggttttaataaacagaccctggcgcttgtgatgtaaatccccttgtggagtatttgccctctgtgtggctgtggcagtggacatctctgagcttcagtttcctccagaaaatagctccattggtggtatctcctttgtttggtttggtgaagattaaattcgatgctctatgt

SEQ ID NO: 368872 - DNA, 1763 bp, Homo sapiens
tgagggagtgcgctgtagccctcgcgcgcatactcgtacaggaggttccggtttcgtttctctgtagtgaaacttctccttggactatcgttggagatgcagcctccccggggccggaacccccgacgagtcagcaaaggccacaagcgccgcgccatggacgcagccatcttggaccggggacaaggcggcacttcgtcccgcccactccgcgtttagaccaattgcaaggcagcgaacctgaccgtgacgagccaatcagatcctgaggaaagttgaccgcgatagagtccttcgtcgcccaatcgtcgtctgtgtcccgcctcttcagtgacgcgaggcagaaccagccaatccctgcacggatagcgcccggaagaggctagaagctggattcagcgtgtccgcgacctcacctttaggtcctgtgaggtcggtggaatcctggggtcctccaaatctaccaggccatctccccagtttcccagttcttcctgcgtgcgggcgagagtggttgggccctcgggaacccactcagagcgaggctaaatttacggagggactttctgttagcagcatgagggcctgtggttagacctatagagggacggcccaggtggcaggatgtcctggtctggccttctccatggcctcaacacgtccctaacttgtggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccactcatggattcaagtcctggctccgcctcttccatcaggaccactattaagccataggagtcctgggggtgcaaagggtgcccctctgtcaacacccttggctcctgtgtttagaggggtggcctgaaggaccttttctgctgggacaagacactgtactgccctctgctgggaaggggttttaataaacagaccctggcgcttgtgatgtcaaaaaaacaaaaaaaaaaaaaaaaaaaaaaaaaaaaaaaaaaaaacggggggcttttttgggggggggggaaaaaagggtttattaagggggggtgggcaagggttgttcgggacccttttttttggacagggggggaaacgggggggggccccaaaaggggggggcggtaaaatttgggaaaagccgcggttttccttcttatgttttcttcggaaacaggaaatgtagacactgacatcaactataaacaacataagcagtagatgttcaaaatatcacagtagtatgaagtacacaataagacagaaatcagagacaagagatacactaaataattacttatcataacaacaatgttaattcataaattcaagaacagaataagacgaacacaaagaaaat

SEQ ID NO: 368873 - DNA, 1475 bp, Homo sapiens
tgagggagtgcgctgtagccctcgcgcgcatactcgtacaggaggttccggtttcgtttctctgtagtgaaacttctccttggactatcgttggagatgcagcctccccggggccggaacccccgacgagtcagcaaaggccacaagcgccgcgccatggacgcagccatcttggaccggggacaaggcggcacttcgtcccgcccactccgcgtttagaccaattgcaaggcagcgaacctgaccgtgacgagccaatcagatcctgaggaaagttgaccgcgatagagtccttcgtcgcccaatcgtcgtctgtgtcccgcctcttcagtgacgcgaggcagaaccagccaatccctgcacggatagcgcccggaagaggctagaagctggattcagcgtgtccgcgacctcacctttaggtcctgtgaggtcggtggaatcctggggtcctccaaatctaccaggccatctccccagtttcccagttcttcctgcgtgcgggcgagagtggttgggccctcgggaacccactcagagcgaggctaaatttacggagggactttctgttagcagcatgagggcctgtggttagacctatagagggacggcccaggtggcaggatgtcctggtctggccttctccatggcctcaacacgtccctaacttgtggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccactcatggattcaagtcctggctccgcctcttccatcaggaccactattaagccataggagtcctgggggtgcaaagggtgcccctctgtcaacacccttggctcctgtgtttagaggggtggcctgaaggaccttttctgctgggacaagacactgtactgccctctgctgggaaggggttttaataaacagaccctggcgcttgtgatgtacaacgacaaaggaaatgatcacaatatgacaactgaactagataacaaataaagtcacatataagatcacccggtcgcggactttcaagggactggcaacaaagcataggacaccg

SEQ ID NO: 368874 - DNA, 1331 bp, Homo sapiens
  misc_feature (1226)..(1227): n is a, c, g, or t
  misc_feature (1229)..(1229): n is a, c, g, or t
  misc_feature (1237)..(1237): n is a, c, g, or t
  misc_feature (1241)..(1241): n is a, c, g, or t
  misc_feature (1248)..(1248): n is a, c, g, or t
  misc_feature (1266)..(1266): n is a, c, g, or t
  misc_feature (1268)..(1268): n is a, c, g, or t
  misc_feature (1270)..(1270): n is a, c, g, or t
  misc_feature (1273)..(1273): n is a, c, g, or t
  misc_feature (1287)..(1287): n is a, c, g, or t
tgagggagtgcgctgtagccctcgcgcgcatactcgtacaggaggttccggtttcgtttctctgtagtgaaacttctccttggactatcgttggagatgcagcctccccggggccggaacccccgacgagtcagcaaaggccacaagcgccgcgccatggacgcagccatcttggaccggggacaaggcggcacttcgtcccgcccactccgcgtttagaccaattgcaaggcagcgaacctgaccgtgacgagccaatcagatcctgaggaaagttgaccgcgatagagtccttcgtcgcccaatcgtcgtctgtgtcccgcctcttcagtgacgcgaggcagaaccagccaatccctgcacggatagcgcccggaagaggctagaagctggattcagcgtgtccgcgacctcacctttaggtcctgtgaggtcggtggaatcctggggtcctccaaatctaccaggccatctccccagtttcccagttcttcctgcgtgcgggcgagagtggttgggccctcgggaacccactcagagcgaggctaaatttacggagggactttctgttagcagcatgagggcctgtggttagacctatagagggacggcccaggtggcaggatgtcctggtctggccttctccatggcctcaacacgtccctaacttgtggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccactcatggattcaagtcctggctccgcctcttccatcaggaccactattaagccataggagtcctgggggtgggtgcctnngnaaactggnctgnttagggnggctgaggactttgtggnanantgntgctcgggagggtnaaaaaccgggtgttttaaaaaaaaaaaacccctttcggacgggg

SEQ ID NO: 368875 - DNA, 1265 bp, Homo sapiens
tgagggagtgcgctgtagccctcgcgcgcatactcgtacaggaggttccggtttcgtttctctgtagtgaaacttctccttggactatcgttggagatgcagcctccccggggccggaacccccgacgagtcagcaaaggccacaagcgccgcgccatggacgcagccatcttggaccggggacaaggcggcacttcgtcccgcccactccgcgtttagaccaattgcaaggcagcgaacctgaccgtgacgagccaatcagatcctgaggaaagttgaccgcgatagagtccttcgtcgcccaatcgtcgtctgtgtcccgcctcttcagtgacgcgaggcagaaccagccaatccctgcacggatagcgcccggaagaggctagaagctggattcagcgtgtccgcgacctcacctttaggtcctgtgaggtcggtggaatcctggggtcctccaaatctaccaggccatctccccagtttcccagttcttcctgcgtgcgggcgagagtggttgggccctcgggaacccactcagagcgaggctaaatttacggagggactttctgttagcagcatgagggcctgtggttagacctatagagggacggcccaggtggcaggatgtcctggtctggccttctccatggcctcaacacgtccctaacttgtggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccaacccttggctcctgtgtttagaggggtggcctgaaggaccttttctgctgggacaagacactgtactgccctctgctgggaaggggttttaataaacagaccctggcgcttgtgatgt

SEQ ID NO: 368876 - DNA, 847 bp, Homo sapiens
ggacactaggctaggtacgaggctggtgttaatcggccgaggggctagaagctggattcagcgtgtccgcgacctcacctttaggtcctgtgagggacggcccaggtggcaggatgtcctggtctggccttctccatggcctcaacacgtccctaacttgtggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccactcatggattcaagtcctggctccgcctcttccatcaggaccactattaagccataggagtcctgggggtgcaaagggtgcccctctgtcaacacccttggctcctgtgtttagaggggtggcctgaaggaccttttctgctgggacaagacactgtactgccctctgctgggaaggggttttaataaacagaccctggcgcttgtgatgt

SEQ ID NO: 368877 - DNA, 850 bp, Homo sapiens
cccaccacacaacacctatacagcccaactcataccaaacaacaaaaattgcatgatagcccgtggttaaatgaacgaggctcactatagtcatgtgggacggcccaggtggcaggatgtcctggtctggccttctccatggcctcaacacgtccctaacttgtggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccactcatggattcaagtcctggctccgcctcttccatcaggaccactattaagccataggagtcctgggggtgcaaagggtgcccctctgtcaacacccttggctcctgtgtttagaggggtggcctgaaggaccttttctgctgggacaagacactgtactgccctctgctgggaaggggttttaataaacagaccctggcgcttgtgatgt

SEQ ID NO: 368878 - DNA, 545 bp, Homo sapiens
tgagggagtgcgctgtagccctcgcgcgcatactcgtacaggaggttccggtttcgtttctctgtagtgaaacttctccttggactatcgttggagatgcagcctccccggggccggaacccccgacgagtcagcaaaggccacaagcgccgcgccatggacgcagccatcttggaccggggacaaggcggcacttcgtcccgcccactccgcgtttagaccaattgcaaggcagcgaacctgaccgtgacgagccaatcagatcctgaggaaagttgaccgcgatagagtccttcgtcgcccaatcgtcgtctgtgtcccgcctcttcatcacgtgagccattctctctcaccctctgcacgcagtgtgatggtaagaggggaccacctggtttcagcgtgtaagggccggcacccttagatccagcaatcagtgttgcccggcgacatggggtggtggttagtcattgaccaaggcctcaagcagtgtctttatttttcctttagttctggaaggcccgatataatatacacgctcgaagggt

SEQ ID NO: 368879 - DNA, 1461 bp, Homo sapiens
tgagggagtgcgctgtagccctcgcgcgcatactcgtacaggaggttccggtttcgtttctctgtagtgaaacttctccttggactatcgttggagatgcagcctccccggggccggaacccccgacgagtcagcaaaggccacaagcgccgcgccatggacgcagccatcttggaccggggacaaggcggcacttcgtcccgcccactccgcgtttagaccaattgcaaggcagcgaacctgaccgtgacgagccaatcagatcctgaggaaagttgaccgcgatagagtccttcgtcgcccaatcgtcgtctgtgtcccgcctcttcagtgacgcgaggcagaaccagccaatccctgcacggatagcgcccggaagaggctagaagctggattcagcgtgtccgcgacctcacctttaggtcctgtgaggtcggtggaatcctggggtcctccaaatctaccaggccatctccccagtttcccagttcttcctgcgtgcgggcgagagtggttgggccctcgggaacccactcagagcgaggctaaatttacggagggactttctgttagcagcatgagggcctgtggttagacctatagaggtatttcctttgatttaagccagaaagtcctgagagcggatcggggagcatttgcggatcggtcactttttcctcctttctgagtctcttatcccctaccacaggacggcccaggtggcaggatgtcctggtctggccttctccatggcctcaacacgtccctaacttgtggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccactcatggattcaagtcctggctccgcctcttccatcaggaccactattaagccataggagtcctgggggtgcaaagggtgcccctctgtcaacacccttggctcctgtgtttagaggggtggcctgaaggaccttttctgctgggacaagacactgtactgccctctgctgggaaggggttttaataaacagaccctggcgcttgtgatgt

SEQ ID NO: 368880 - DNA, 1324 bp, Homo sapiens
tgagggagtgcgctgtagccctcgcgcgcatactcgtacaggaggttccggtttcgtttctctgtagtgaaacttctccttggactatcgttggagatgcagcctccccggggccggaacccccgacgagtcagcaaaggccacaagcgccgcgccatggacgcagccatcttggaccggggacaaggcggcacttcgtcccgcccactccgcgtttagaccaattgcaaggcagcgaacctgaccgtgacgagccaatcagatcctgaggaaagttgaccgcgatagagtccttcgtcgcccaatcgtcgtctgtgtcccgcctcttcagtgacgcgaggcagaaccagccaatccctgcacggatagcgcccggaagaggctagaagctggattcagcgtgtccgcgacctcacctttaggtcctgtgagggacggcccaggtggcaggatgtcctggtctggccttctccatggcctcaacacgtccctaacttgtggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccactcatggattcaagtcctggctccgcctcttccatcaggaccactattaagccataggagtcctgggggtgcaaagggtgcccctctgtcaacacccttggctcctgtgtttagaggggtggcctgaaggaccttttctgctgggacaagacactgtactgccctctgctgggaaggggttttaataaacagaccctggcgcttgtgatgtaaatccccttgtggagtatttgccctctgtgtggctgtggcagtggacatctctgagcttcagtttcctccagaaaatagctccattggtggtatctcctttgtttggtttggtgaagattaaattcgatgctctatgt

SEQ ID NO: 368881 - DNA, 1583 bp, Homo sapiens
tgagggagtgcgctgtagccctcgcgcgcatactcgtacaggaggttccggtttcgtttctctgtagtgaaacttctccttggactatcgttggagatgcagcctccccggggccggaacccccgacgagtcagcaaaggccacaagcgccgcgccatggacgcagccatcttggaccggggacaaggcggcacttcgtcccgcccactccgcgtttagaccaattgcaaggcagcgaacctgaccgtgacgagccaatcagatcctgaggaaagttgaccgcgatagagtccttcgtcgcccaatcgtcgtctgtgtcccgcctcttcagtgacgcgaggcagaaccagccaatccctgcacggatagcgcccggaagaggctagaagctggattcagcgtgtccgcgacctcacctttaggtcctgtgaggtcggtggaatcctggggtcctccaaatctaccaggccatctccccagtttcccagttcttcctgcgtgcgggcgagagtggttgggccctcgggaacccactcagagcgaggctaaatttacggagggactttctgttagcagcatgagggcctgtggttagacctatagagggacggcccaggtggcaggatgtcctggtctggccttctccatggcctcaacacgtccctaacttgtggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccactcatggattcaagtcctggctccgcctcttccatcaggaccactattaagccataggagtcctgggggtgcaaagggtgcccctctgtcaacacccttggctcctgtgtttagaggggtggcctgaaggaccttttctgctgggacaagacactgtactgccctctgctgggaaggggttttaataaacagaccctggcgcttgtgatgtaaataaaaacaaaacaaaaacaaaaacaacaaatataatataaaaacaatcaaaaaaaagatccgaggcgacaatataatgcgacgcgcagagaaaaaagaagatcataaaattgcacgatgtcaataagatatttctcgtaacaaccatttttttttaaaaaaagcggaaaatacgcggagaccacaagaagcagagataaaatgcaaacacagatagaaacag

SEQ ID NO: 368882 - DNA, 1313 bp, Homo sapiens
tgagggagtgcgctgtagccctcgcgcgcatactcgtacaggaggttccggtttcgtttctctgtagtgaaacttctccttggactatcgttggagatgcagcctccccggggccggaacccccgacgagtcagcaaaggccacaagcgccgcgccatggacgcagccatcttggaccggggacaaggcggcacttcgtcccgcccactccgcgtttagaccaattgcaaggcagcgaacctgaccgtgacgagccaatcagatcctgaggaaagttgaccgcgatagagtccttcgtcgcccaatcgtcgtctgtgtcccgcctcttcagtgacgcgaggcagaaccagccaatccctgcacggatagcgcccggaagaggctagaagctggattcagcgtgtccgcgacctcacctttaggtcctgtgaggtcggtggaatcctggggtcctccaaatctaccaggccatctccccagtttcccagttcttcctgcgtgcgggcgagagtggttgggccctcgggaacccactcagagcgaggctaaatttacggagggactttctgttagcagcatgagggcctgtggttagacctatagagggacggcccaggtggcaggatgtcctggtctggccttctccatggcctcaacacgtccctaacttgtggcccagctctggttccccggctctgggctacctgctccatggctaccctgaaccagatgcaccgcctggggccccagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccactcatggattcaagtcctggctccgcctcttccatcaggaccactattaagccataggagtcctgggggtgcaaagggtgcccctctgtcaacacccttggctcctgtgtttagaggggtggcctgaaggaccttttctgctgggacaagacactgtactgccctctgctgggaaggggttttaataaacagaccctggcgcttgtgatgt

SEQ ID NO: 368883 - DNA, 1119 bp, Homo sapiens
tgagggagtgcgctgtagccctcgcgcgcatactcgtacaggaggttccggtttcgtttctctgtagtgaaacttctccttggactatcgttggagatgcagcctccccggggccggaacccccgacgagtcagcaaaggccacaagcgccgcgccatggacgcagccatcttggaccggggacaaggcggcacttcgtcccgcccactccgcgtttagaccaattgcaaggcagcgaacctgaccgtgacgagccaatcagatcctgaggaaagttgaccgcgatagagtccttcgtcgcccaatcgtcgtctgtgtcccgcctcttcagtgacgcgaggcagaaccagccaatccctgcacggatagcgcccggaagaggctagaagctggattcagcgtgtccgcgacctcacctttaggtcctgtgagggacggcccaggtggcaggatgtcctggtctggccttctccatggcctcaacacgtccctaacttgtggtaagtgggggacttgggcttcagggacgaggctagagggggagggttattcgctcttggacttgtgtgcctccgtcggagccccgagggaaacgggggtggaaaaacacggtggggttttggcagagctagggctgctagagcaagaggtgggaagcagctgcatggagggctactgcgtgtcaagcggcgtttgggtcagttttattatttatttatttaagatctccctctgtcgcccaggctgaagtgcagcggtgtgatcacagctcactgcagtctcgacctcctgggctcaagtgatcctcccgcctcagcctcccaagtagctgggaccacaggcctgcagaaccacaaccagctaactttttgattctttgtagagagggaggtctccctgtgtcgcccagtctggccttaactcctgagctcaagtgaccctccacagcctccaaaagtgctaggattacatgcatgagccactgagcctactattattttaaacagcattaaaaataatgcttcctggccagccgtggtggctcacgcctgtaatcccagcactttgagaggccgaggtcaggagttcgagaccagcctgaccaacatggtgaaaccc

SEQ ID NO: 368884 - DNA, 5262 bp, Homo sapiens
  misc_feature (2114)..(2114): n is a, c, g, or t
  misc_feature (2860)..(2860): n is a, c, g, or t
ggcctcagaggactcaggtgcacacctgcatggcagaaccaggctctgggcccaggtgtctgacactgagtagctcgcctctcccaggggcgctggtgtgggccgatgcaagtgccaccatgggtgtgtgtgtggctccctgggccacctcactccaattaagcaggtccaggtgggacagcctgggaccagccctgcagcagcatgtgttaaccacaacagatggctgtagccaccaggcttgtccttggtgcagtcagcctgggggctgcgggggcttgtggaagcatgtgggaagacggtcccactggtcagcagagcagggtcctcaccgacccacagaggagcatgtcacaggacaggcaggcgtgtcagggaaggccaggctagtgccagccaagggcattgcctcccagactgcccttttcctcacactcccacgacacagccctcaaagcctgtgcccctgtgggtccctggccaaggagcaagggctgccctgcctgggccccccccgccagccccttggtcacctcatgctgtgtgccaggctgggggagtgtgcctgtgtgtatgtccaggtggcatttggatgaagacacaggtgtgtggtgaggctgtgcgggaggatgggcctatgcgtgcggtgggcaggtggtgtggaggcaggcgggcgggcgtgtggcagcgcgccggctgagcccctccacttccaggtcagccagagcagcctccccatgctgtcctcgccgtcaccgggccagcaggtgcagaccccgcagtcgatgccccctcccccccagccgtccccgcagcccggccagcccagctcacagcccaactccaacgtcaggtaggcctggcctggggtgcccctccccacctggccctcgaggctggccctgcctggaccccggctcacatgtttctctcacttggctgcagctctggccctgccccatctcccagtagcttcctgcccagcccctcaccgcagccctcccagagcccagtgacggcgcggaccccacagaacttcagtgtcccctcacctggacctttaaacacacctggtaagttgggcctgaggtgctaaggtcactcctcacctttatgaggcctcagctcatactgggtgtgcgagctctggggccctcagagctcaagttccccacccgagggtcgagggctgtggcctcacccgcctgtgtcctgcagtgaaccccagctctgtcatgagcccagctggctccagccaggctgaggagcagcagtacctggacaagctgaagcagctgtcgaagtacatcgagcccctgcgccgcatgatcaacaagatcgacaagaacgaagacagaaaaaaggacctgagtaagatgaagagccttctggacattctgacagacccctcgaagcggtgagctttgcccacagcccacggagggtccacaagggcacagatagcccagccatggatgggcacttggtgatgatgtgggtttaacaaaggcaccaggcagctctttggaccctggccagaggcctccaaggctccactctggtgtgtgctggggcttcaagcccaggcttcatcttggcccatgcccagcctttgccctattcctggctgctgctgtggccctcatgctgggccatcacagccagacctcatccagtcagcagccaggggcccagcttgcagtggcctgaccatcagctggcccagatgggcctgagcctgacctggagttctgcccctgacttgctggtgaccatgggcaggcgactgcatctcagttaccccatttgtagcccacgtgtgttgtcatgaaaatgaaacaaggtggcgctggtgagaagcaggtggaaggcagggctgctggccacaggctgctgtgaggatcagagctcgggcagtacctccaaactgcatgggcattggcatatacctccctttcacctcaactcaggctatcccccaacccctgtctagaagggtctctctgttctgcttgtctggatagaatgccagtcactattgggtggtcctccaggtcttcatgggttgatcctttgttagggttatagggatgagtggggcagggactggcctncatgacaatgaggcattcacagcctgatcaggggcctggccactgtcccttctcttgacccatcacctcactctgccaaccagggacaagcagctcctggggttgagggctgcctgccttcaactctgggtctgggaacagctggtcaactggtaggagctcctgcagaggtttctgatggctgaggcccagtggcagtagttgggatcctgagcctgagaactgccatgtcttccactctttcagcccaagtcctctctctctgcaggtgtcccctgaagaccttgcaaaagtgtgagatcgccctggagaaactcaagaatgacatggcggtggtgagtgggatgccagacacccctaggggaaccagggctctcctaagagctcctgggagtgccgctgagagggccttcaaggtcagggcatctgggcgggggccgggcctgaccttggaccctgcccacgaggcttcctggccaggtctgctgtgctgggtgggaacatgggagaagtcaccctctgtctacggcccccgtgggtgcctccttcacccatttcagaggaggcagggactgtagggaggataggctgtgggggtgggggattattcccaggatcagccaacattgtctgcacaagggtggaggctgtgagagaggcctcgggaatctgactgtgagtgaccatgggcctggggtgtgaaggccccctaaatggggaaccctcgggtcccgggctgctgaccntgcccatcctgtctccagcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacgtatgtccagctgggctgggctttgcggagggcggccagccctgggccgcgtgtgccaggtgtggtcaccatgccgcctccccaggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctgggtgagtgtccagagggccgggactggtgtgggaaagcaggccctgaccgcagccccaggactctgccatccaagccagatggcacagcgcccagaacccaccctgtgttcacgccccgccaggctgtctgctctatcctcacacacaccgggctccagacagcctggccatgcctcagtccccactgccagagcccgcacactctcacctccccaacacagatgtggctttgcttgcctgggccctagggaggtggtaggcaggacctctgggcacccatcaatgcagagcactccaggcttcacgtttggaaatctgagagtcagagagacctcctccaggctttgccacaagcttcaccagaacctccctgggtgtggagtcctgttccagagcagggctgtgaggcagggcaggccggggcttgtccaggtcacagatagagccttctgtgttgcagatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcacccctactcgttcctatagaacacagaggacataggaaacccttaaaacacacatgggattctctggtcacagttttgggttcaggctatgctgctttgggcaggtggagcaccccccgaggaagcctgcaagtccagggcacaggctgccttttggagggagggctggcccataggtgctgctggctccccgccaccagctgggcctcagccctcacggcattcctgctgagcaccgtggggcacccagggagcaggggcgtcagggatcctgctgccggcacccctgtgccgctggcatgagggccgtgtccccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctgtgaaaacacacagaagaagagaacgagcaacacacgccagaaaaacagaacagaacagaacaagcagggcgggcgacacgcagagagagtacgcccagagcgggcagacacacgtagacacgcaaccaaggatatgtcgagaaacaaagggagcccccgagagaagagaagcgatgatgtatctatcagacacgctgtcgagacggcgagtgctgtgtattatcacggcgttggcagaggcggatacaaaggttaacgaggggaagaactttagttaggaggacgatacttgtattcggagaggagggaagaaaaatggggggacatgtacgtaaggaggaagtgtgacgctttaggtgagatat

SEQ ID NO: 368885 - DNA, 3245 bp, Homo sapiens
ccggcgcgacttgggcctggctctgtgactgaggcggcggcggtggcggccaagcgggatacgggcggcgggagctggggaacaggcatggacgtttccgggcaagagaccgactggcggagcaccgccttccggcagaagctggtcagtcaaatcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccaggtcagccagagcagcctccccatgctgtcctcgccgtcaccgggccagcaggtgcagaccccgcagtcgatgccccctcccccccagccgtccccgcagcccggccagcccagctcacagcccaactccaacgtcagctctggccctgccccatctcccagtagcttcctgcccagcccctcaccgcagccctcccagagcccagtgacggcgcggaccccacagaacttcagtgtcccctcacctggacctttaaacacacctgtgaaccccagctctgtcatgagcccagctggctccagccaggctgaggagcagcagtacctggacaagctgaagcagctgtcgaagtacatcgagcccctgcgccgcatgatcaacaagatcgacaagaacgaagacagaaaaaaggacctgagtaagatgaagagccttctggacattctgacagacccctcgaagcggtgtcccctgaagaccttgcaaaagtgtgagatcgccctggagaaactcaagaatgacatggcggtgcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctggatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcacccctactcgttcctatagaacacagaggacataggaaacccttaaaacacacatgggattctctggtcacagttttgggttcaggctatgctgctttgggcaggtggagcaccccccgaggaagcctgcaagtccagggcacaggctgccttttggagggagggctggcccataggtgctgctggctccccgccaccagctgggcctcagccctcacggcattcctgctgagcaccgtggggcacccagggagcaggggcgtcagggatcctgctgccggcacccctgtgccgctggcatgagggccgtgtccccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctg

SEQ ID NO: 368886 - DNA, 3359 bp, Homo sapiens
tgcagcccccgcaagacgggcagcccccgcaagacgctgggaccacagcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccagatgatcacggaagccttggcccaaggtgggatgcacataagagcccggttcccgcctaccaccgctgtgtccgccatcccgtcaagctccatccctttgggcagacagcccatggcacaggtcagccagagcagcctccccatgctgtcctcgccgtcaccgggccagcaggtgcagaccccgcagtcgatgccccctcccccccagccgtccccgcagcccggccagcccagctcacagcccaactccaacgtcagctctggccctgccccatctcccagtagcttcctgcccagcccctcaccgcagccctcccagagcccagtgacggcgcggaccccacagaacttcagtgtcccctcacctggacctttaaacacacctgtgaaccccagctctgtcatgagcccagctggctccagccaggctgaggagcagcagtacctggacaagctgaagcagctgtcgaagtacatcgagcccctgcgccgcatgatcaacaagatcgacaagaacgaagacagaaaaaaggacctgagtaagatgaagagccttctggacattctgacagacccctcgaagcggtgtcccctgaagaccttgcaaaagtgtgagatcgccctggagaaactcaagaatgacatggcggtgcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctggatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcacccctactcgttcctatagaacacagaggacataggaaacccttaaaacacacatgggattctctggtcacagttttgggttcaggctatgctgctttgggcaggtggagcaccccccgaggaagcctgcaagtccagggcacaggctgccttttggagggagggctggcccataggtgctgctggctccccgccaccagctgggcctcagccctcacggcattcctgctgagcaccgtggggcacccagggagcaggggcgtcagggatcctgctgccggcacccctgtgccgctggcatgagggccgtgtccccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctgtgaaaacacacagaagaagagaacgagcaacacacgccagaaaaacagaacagaacagaacaagcagggcgggcgacacgcagagagagtacgcccagagcgggcagacacacgtagacacgcaaccaaggatatgtcgagaaacaaagggagcccccgagagaagagaagcgatgatgtatctatcagacacgctgtcgagacggcgagtgctgtgtattatcacggcgttggcagaggcggatacaaaggttaacgaggggaagaactttagttaggaggacgatacttgtattcggagaggagggaagaaaaatggggggacatgtacgtaaggaggaagtgtgacgctttaggtgagatat

SEQ ID NO: 368887 - DNA, 3587 bp, Homo sapiens
tgcagcccccgcaagacgggcagcccccgcaagacgctgggaccacagcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccaggtcagccagagcagcctccccatgctgtcctcgccgtcaccgggccagcaggtgcagaccccgcagtcgatgccccctcccccccagccgtccccgcagcccggccagcccagctcacagcccaactccaacgtcagctctggccctgccccatctcccagtagcttcctgcccagcccctcaccgcagccctcccagagcccagtgacggcgcggaccccacagaacttcagtgtcccctcacctggacctttaaacacacctgtgaaccccagctctgtcatgagcccagctggctccagccaggctgaggagcagcagtacctggacaagctgaagcagctgtcgaagtacatcgagcccctgcgccgcatgatcaacaagatcgacaagaacgaagacagaaaaaaggacctgagtaagatgaagagccttctggacattctgacagacccctcgaagcggtgtcccctgaagaccttgcaaaagtgtgagatcgccctggagaaactcaagaatgacatggcggtgcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacgtatgtccagctgggctgggctttgcggagggcggccagccctgggccgcgtgtgccaggtgtggtcaccatgccgcctccccaggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctggatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcacccctactcgttcctatagaacacagaggacataggaaacccttaaaacacacatgggattctctggtcacagttttgggttcaggctatgctgctttgggcaggtggagcaccccccgaggaagcctgcaagtccagggcacaggctgccttttggagggagggctggcccataggtgctgctggctccccgccaccagctgggcctcagccctcacggcattcctgctgagcaccgtggggcacccagggagcaggggcgtcagggatcctgctgccggcacccctgtgccgctggcatgagggccgtgtccccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctgtgaaaacacacagaagaagagaacgagcaacacacgccagaaaaacagaacagaacagaacaagcagggcgggcgacacgcagagagagtacgcccagagcgggcagacacacgtagacacgcaaccaaggatatgtcgagaaacaaagggagcccccgagagaagagaagcgatgatgtatctatcagacacgctgtcgagacggcgagtgctgtgtattatcacggcgttggcagaggcggatacaaaggttaacgaggggaagaactttagttaggaggacgatacttgtattcggagaggagggaagaaaaatggggggacatgtacgtaaggaggaagtgtgacgctttaggtgagatat

SEQ ID NO: 368888 - DNA, 3138 bp, Homo sapiens
tgcagcccccgcaagacgggcagcccccgcaagacgctgggaccacagcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccaggtcagccagagcagcctccccatgctgtcctcgccgtcaccgggccagcaggtgcagaccccgcagtcgatgccccctcccccccagccgtccccgcagcccggccagcccagctcacagcccaactccaacgtcagctctggccctgccccatctcccagtagcttcctgcccagcccctcaccgcagccctcccagagcccagtgacggcgcggaccccacagaacttcagtgtcccctcacctggacctttaaacacacctgtgaaccccagctctgtcatgagcccagctggctccagccaggctgaggagcagcagtacctggacaagctgaagcagctgtcgaagtacatcgagcccctgcgccgcatgatcaacaagatcgacaagaacgaagacagaaaaaaggacctgagtaagatgaagagccttctggacattctgacagacccctcgaagcggtgtcccctgaagaccttgcaaaagtgtgagatcgccctggagaaactcaagaatgacatggcggtgcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctggatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcacccctactcgttcctatagaacacagaggacataggaaacccttaaaacacacatgggattctctggtcacagttttgggttcaggctatgctgctttgggcaggtggagcaccccccgaggaagcctgcaagtccagggcacaggctgccttttggagggagggctggcccataggtgctgctggctccccgccaccagctgggcctcagccctcacggcattcctgctgagcaccgtggggcacccagggagcaggggcgtcagggatcctgctgccggcacccctgtgccgctggcatgagggccgtgtccccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctg

SEQ ID NO: 368889 - DNA, 3743 bp, Homo sapiens
tgcagcccccgcaagacgggcagcccccgcaagacgctgggaccacagcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccaggtcagccagagcagcctccccatgctgtcctcgccgtcaccgggccagcaggtgcagaccccgcagtcgatgccccctcccccccagccgtccccgcagcccggccagcccagctcacagcccaactccaacgtcagctctggccctgccccatctcccagtagcttcctgcccagcccctcaccgcagccctcccagagcccagtgacggcgcggaccccacagaacttcagtgtcccctcacctggacctttaaacacacctgtgaaccccagctctgtcatgagcccagctggctccagccaggctgaggagcagcagtacctggacaagctgaagcagctgtcgaagtacatcgagcccctgcgccgcatgatcaacaagatcgacaagaacgaagacagaaaaaaggacctgagtaagatgaagagccttctggacattctgacagacccctcgaagcggtgtcccctgaagaccttgcaaaagtgtgagatcgccctggagaaactcaagaatgacatggcggtgcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctggatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcacccctactcgttcctatagaacacagaggacataggaaacccttaaaacacacatgggattctctggtcacagttttgggttcaggctatgctgctttgggcaggtggagcaccccccgaggaagcctgcaagtccagggcacaggctgccttttggagggagggctggcccataggtgctgctggctccccgccaccagctgggcctcagccctcacggcattcctgctgagcaccgtggggcacccagggagcaggggcgtcagggatcctgctgccggcacccctgtgccgctggcatgagggccgtgtccccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctgtgttaaaaaaaaaaaaaaaaaaaaaaaaaaaaaaaaaaaaaaaaaaaaaaaaaaagaaaacaagaaaaaaaaagaagaggggcggcggcgccctcaagaagattcgtccgccggaggagagccaccaaatgtgcgacacgacccccatttttgttgtcaaagaggggcccccacaaagggaggccgctattaagaaggcggagcgaagggccgccgacgatttaaaacacagacggcccggacggggggaaagacaccggctcgcctccgggaggagaaccctccgaggagaaaggagggcacccctaccatctctgtgggcggggggcggccaacaactactggggcggcgcacaacatctcaccacccaccagagagcgatagtactactaaacgcccctctacaaggggagcgacatatatctatatcaacatatctttaccaaggcgagtgcatatataaatctgcgggcgcaaaacacacctcaagcgcagaagaattatcttgcctcgtcgccggcgtacgtagaagcaaattatactcttctcgctccaaccaacccggaggatacttcaatctcgtattgacagcacaaacattttt

SEQ ID NO: 368890 - DNA, 3449 bp, Homo sapiens
tgcagcccccgcaagacgggcagcccccgcaagacgctgggaccacagcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccaggtcagccagagcagcctccccatgctgtcctcgccgtcaccgggccagcaggtgcagaccccgcagtcgatgccccctcccccccagccgtccccgcagcccggccagcccagctcacagcccaactccaacgtcagctctggccctgccccatctcccagtagcttcctgcccagcccctcaccgcagccctcccagagcccagtgacggcgcggaccccacagaacttcagtgtcccctcacctggacctttaaacacacctgtgaaccccagctctgtcatgagcccagctggctccagccaggctgaggagcagcagtacctggacaagctgaagcagctgtcgaagtacatcgagcccctgcgccgcatgatcaacaagatcgacaagaacgaagacagaaaaaaggacctgagtaagatgaagagccttctggacattctgacagacccctcgaagcggtgtcccctgaagaccttgcaaaagtgtgagatcgccctggagaaactcaagaatgacatggcggtgcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctggatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagcctcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcacccctactcgttcctatagaacacagaggacataggaaacccttaaaacacacatgggattctctggtcacagttttgggttcaggctatgctgctttgggcaggtggagcaccccccgaggaagcctgcaagtccagggcacaggctgccttttggagggagggctggcccataggtgctgctggctccccgccaccagctgggcctcagccctcacggcattcctgctgagcaccgtggggcacccagggagcaggggcgtcagggatcctgctgccggcacccctgtgccgctggcatgagggccgtgtccccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctgtgaaaacacacagaagaagagaacgagcaacacacgccagaaaaacagaacagaacagaacaagcagggcgggcgacacgcagagagagtacgcccagagcgggcagacacacgtagacacgcaaccaaggatatgtcgagaaacaaagggagcccccgagagaagagaagcgatgatgtatctatcagacacgctgtcgagacggcgagtgctgtgtattatcacggcgttggcagaggcggatacaaaggttaacgaggggaagaactttagttaggaggacgatacttgtattcggagaggagggaagaaaaatggggggacatgtacgtaaggaggaagtgtgacgctttaggtgagatat

SEQ ID NO: 368891 - DNA, 2887 bp, Homo sapiens
tgcagcccccgcaagacgggcagcccccgcaagacgctgggaccacagcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtaacctatgccagccgctcctggatgccgtcctggccaacatccgctcacctgtcttcaaccattccctgtaccgcacattcgttccagccatgaccgccattcacggcccacccatcacggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctggatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcacccctactcgttcctatagaacacagaggacataggaaacccttaaaacacacatgggattctctggtcacagttttgggttcaggctatgctgctttgggcaggtggagcaccccccgaggaagcctgcaagtccagggcacaggctgccttttggagggagggctggcccataggtgctgctggctccccgccaccagctgggcctcagccctcacggcattcctgctgagcaccgtggggcacccagggagcaggggcgtcagggatcctgctgccggcacccctgtgccgctggcatgagggccgtgtccccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctgtgaaaacacacagaagaagagaacgagcaacacacgccagaaaaacagaacagaacagaacaagcagggcgggcgacacgcagagagagtacgcccagagcgggcagacacacgtagacacgcaaccaaggatatgtcgagaaacaaagggagcccccgagagaagagaagcgatgatgtatctatcagacacgctgtcgagacggcgagtgctgtgtattatcacggcgttggcagaggcggatacaaaggttaacgaggggaagaactttagttaggaggacgatacttgtattcggagaggagggaagaaaaatggggggacatgtacgtaaggaggaagtgtgacgctttaggtgagatat

SEQ ID NO: 368892 - DNA, 3801 bp, Homo sapiens
tgcagcccccgcaagacgggcagcccccgcaagacgctgggaccacagcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccaggtcagccagagcagcctccccatgctgtcctcgccgtcaccgggccagcaggtgcagaccccgcagtcgatgccccctcccccccagccgtccccgcagcccggccagcccagctcacagcccaactccaacgtcagctctggccctgccccatctcccagtagcttcctgcccagcccctcaccgcagccctcccagagcccagtgacggcgcggaccccacagaacttcagtgtcccctcacctggacctttaaacacacctgtgaaccccagctctgtcatgagcccagctggctccagccaggctgaggagcagcagtacctggacaagctgaagcagctgtcgaagtacatcgagcccctgcgccgcatgatcaacaagatcgacaagaacgaagacagaaaaaaggacctgagtaagatgaagagccttctggacattctgacagacccctcgaagcggtgtcccctgaagaccttgcaaaagtgtgagatcgccctggagaaactcaagaatgacatggcggtggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctgggtgagtgtccagagggccgggactggtgtgggaaagcaggccctgaccgcagccccaggactctgccatccaagccagatggcacagcgcccagaacccaccctgtgttcacgccccgccaggctgtctgctctatcctcacacacaccgggctccagacagcctggccatgcctcagtccccactgccagagcccgcacactctcacctccccaacacagatgtggctttgcttgcctgggccctagggaggtggtaggcaggacctctgggcacccatcaatgcagagcactccaggcttcacgtttggaaatctgagagtcagagagacctcctccaggctttgccacaagcttcaccagaacctccctgggtgtggagtcctgttccagagcagggctgtgaggcagggcaggccggggcttgtccaggtcacagatagagccttctgtgttgcagatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcacccctactcgttcctatagaacacagaggacataggaaacccttaaaacacacatgggattctctggtcacagttttgggttcaggctatgctgctttgggcaggtggagcaccccccgaggaagcctgcaagtccagggcacaggctgccttttggagggagggctggcccataggtgctgctggctccccgccaccagctgggcctcagccctcacggcattcctgctgagcaccgtggggcacccagggagcaggggcgtcagggatcctgctgccggcacccctgtgccgctggcatgagggccgtgtccccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctgtgaaaacacacagaagaagagaacgagcaacacacgccagaaaaacagaacagaacagaacaagcagggcgggcgacacgcagagagagtacgcccagagcgggcagacacacgtagacacgcaaccaaggatatgtcgagaaacaaagggagcccccgagagaagagaagcgatgatgtatctatcagacacgctgtcgagacggcgagtgctgtgtattatcacggcgttggcagaggcggatacaaaggttaacgaggggaagaactttagttaggaggacgatacttgtattcggagaggagggaagaaaaatggggggacatgtacgtaaggaggaagtgtgacgctttaggtgagatat

SEQ ID NO: 368893 - DNA, 1253 bp, Homo sapiens
  misc_feature (1247)..(1247): n is a, c, g, or t
  misc_feature (1253)..(1253): n is a, c, g, or t
tgcagcccccgcaagacgggcagcccccgcaagacgctgggaccacagcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccaggtcagccagagcagcctccccatgctgtcctcgccgtcaccgggccagcaggtgcagaccccgcagtcgatgccccctccccccctgctcgctgttttcctgccagcttctcaangccggn

SEQ ID NO: 368894 - DNA, 1261 bp, Homo sapiens
tgcagcccccgcaagacgggcagcccccgcaagacgctgggaccacagcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccagatgatcacggaagccttggcccaaggtgggatgcacataagagcccggttcccgcctaccaccgctgtgtccgccatctcttaaagcaggcaacacctaggaccatcagttaccgaagtcacgagactc

SEQ ID NO: 368895 - DNA, 191 bp, Homo sapiens
ggggattgagcctgtaggtaggcgagatctgtgctctgtgagccttacgccctttgagccatggtcagtctggtaggccctttcctgagaagctctgcccttgtgttcccacagatcctatgaatgcactccagagcctgactggcggacctgctgcgggagccgctggaattggcatgcctcctcggggc

SEQ ID NO: 368896 - DNA, 2748 bp, Homo sapiens
ggcctcagaggactcaggtgcacacctgcatggcagaaccaggctctgggcccaggtgtctgacactgagtagctcgcctctcccaggggcgctggtgtgggccgatgcaagtgccaccatgggtgtgtgtgtggctccctgggccacctcactccaattaagcaggtccaggtgggacagcctgggaccagccctgcagcagcatgtgttaaccacaacagatggctgtagccaccaggcttgtccttggtgcagtcagcctgggggctgcgggggcttgtggaagcatgtgggaagacggtcccactggtcagcagagcagggtcctcaccgacccacagaggagcatgtcacaggacaggcaggcgtgtcagggaaggccaggctagtgccagccaagggcattgcctcccagactgcccttttcctcacactcccacgacacagccctcaaagcctgtgcccctgtgggtccctggccaaggagcaagggctgccctgcctgggccccccccgccagccccttggtcacctcatgctgtgtgccaggctgggggagtgtgcctgtgtgtatgtccaggtggcatttggatgaagacacaggtgtgtggtgaggctgtgcgggaggatgggcctatgcgtgcggtgggcaggtggtgtggaggcaggcgggcgggcgtgtggcagcgcgccggctgagcccctccacttccaggtcagccagagcagcctccccatgctgtcctcgccgtcaccgggccagcaggtgcagaccccgcagtcgatgccccctcccccccagccgtccccgcagcccggccagcccagctcacagcccaactccaacgtcagctctggccctgccccatctcccagtagcttcctgcccagcccctcaccgcagccctcccagagcccagtgacggcgcggaccccacagaacttcagtgtcccctcacctggacctttaaacacacctgtgaaccccagctctgtcatgagcccagctggctccagccaggctgaggagcagcagtacctggacaagctgaagcagctgtcgaagtacatcgagcccctgcgccgcatgatcaacaagatcgacaagaacgaagacagaaaaaaggacctgagtaagatgaagagccttctggacattctgacagacccctcgaagcggtgtcccctgaagaccttgcaaaagtgtgagatcgccctggagaaactcaagaatgacatggcggtgcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctggatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcacccctactcgttcctatagaacacagaggacataggaaacccttaaaacacacatgggattctctggtcacagttttgggttcaggctatgctgctttgggcaggtggagcaccccccgaggaagcctgcaagtccagggcacaggctgccttttggagggagggctggcccataggtgctgctggctccccgccaccagctgggcctcagccctcacggcattcctgctgagcaccgtggggcacccagggagcaggggcgtcagggatcctgctgccggcacccctgtgccgctggcatgagggccgtgtccccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctgtgtttgtcagttgttcaaaaaagtgt

SEQ ID NO: 368897 - DNA, 3623 bp, Homo sapiens
tgcagcccccgcaagacgggcagcccccgcaagacgctgggaccacagcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccagatgatcacggaagccttggcccaaggtgggatgcacataagagcccggttcccgcctaccaccgctgtgtccgccatcccgtcaagctccatccctttgggcagacagcccatggcacaggtcagccagagcagcctccccatgctgtcctcgccgtcaccgggccagcaggtgcagaccccgcagtcgatgccccctcccccccagccgtccccgcagcccggccagcccagctcacagcccaactccaacgtcagctctggccctgccccatctcccagtagcttcctgcccagcccctcaccgcagccctcccagagcccagtgacggcgcggaccccacagaacttcagtgtcccctcacctggacctttaaacacacctgtgaaccccagctctgtcatgagcccagctggctccagccaggctgaggagcagcagtacctggacaagctgaagcagctgtcgaagtacatcgagcccctgcgccgcatgatcaacaagatcgacaagaacgaagacagaaaaaaggacctgagtaagatgaagagccttctggacattctgacagacccctcgaagcggtgtcccctgaagaccttgcaaaagtgtgagatcgccctggagaaactcaagaatgacatggcggtgcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctggatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcacccctactcgttcctatagaacacagaggacataggaaacccttaaaacacacatgggattctctggtcacagttttgggttcaggctatgctgctttgggcaggtggagcaccccccgaggaagcctgcaagtccagggcacaggctgccttttggagggagggctggcccataggtgctgctggctccccgccaccagctgggcctcagccctcacggcattcctgctgagcaccgtggggcacccagggagcaggggcgtcagggatcctgctgccggcacccctgtgccgctggcatgagggccgtgtccccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctgtgaaaacacacagaagaagagaacgagcaacacacgccagaaaaacagaacagaacagaacaagcagggcgggcgacacgcagagagagtacgcccagagcgggcagacacacgtagacacgcaaccaaggatatgtcgagaaacaaagggagcccccgagagaagagaagcgatgatgtatctatcagacacgctgtcgagacggcgagtgctgtgtattatcacggcgttggcagaggcggatacaaaggttaacgaggggaagaactttagttaggaggacgatacttgtattcggagaggagggaagaaaaatggggggacatgtacgtaaggaggaagtgtgacgctttaggtgagatat

SEQ ID NO: 368898 - DNA, 3503 bp, Homo sapiens
tgcagcccccgcaagacgggcagcccccgcaagacgctgggaccacagcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccaggtcagccagagcagcctccccatgctgtcctcgccgtcaccgggccagcaggtgcagaccccgcagtcgatgccccctcccccccagccgtccccgcagcccggccagcccagctcacagcccaactccaacgtcagctctggccctgccccatctcccagtagcttcctgcccagcccctcaccgcagccctcccagagcccagtgacggcgcggaccccacagaacttcagtgtcccctcacctggacctttaaacacacctgtgaaccccagctctgtcatgagcccagctggctccagccaggctgaggagcagcagtacctggacaagctgaagcagctgtcgaagtacatcgagcccctgcgccgcatgatcaacaagatcgacaagaacgaagacagaaaaaaggacctgagtaagatgaagagccttctggacattctgacagacccctcgaagcggtgtcccctgaagaccttgcaaaagtgtgagatcgccctggagaaactcaagaatgacatggcggtgcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctggatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcacccctactcgttcctatagaacacagaggacataggaaacccttaaaacacacatgggattctctggtcacagttttgggttcaggctatgctgctttgggcaggtggagcaccccccgaggaagcctgcaagtccagggcacaggctgccttttggagggagggctggcccataggtgctgctggctccccgccaccagctgggcctcagccctcacggcattcctgctgagcaccgtggggcacccagggagcaggggcgtcagggatcctgctgccggcacccctgtgccgctggcatgagggccgtgtccccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctgtgaaaacacacagaagaagagaacgagcaacacacgccagaaaaacagaacagaacagaacaagcagggcgggcgacacgcagagagagtacgcccagagcgggcagacacacgtagacacgcaaccaaggatatgtcgagaaacaaagggagcccccgagagaagagaagcgatgatgtatctatcagacacgctgtcgagacggcgagtgctgtgtattatcacggcgttggcagaggcggatacaaaggttaacgaggggaagaactttagttaggaggacgatacttgtattcggagaggagggaagaaaaatggggggacatgtacgtaaggaggaagtgtgacgctttaggtgagatat

SEQ ID NO: 368899 - DNA, 3598 bp, Homo sapiens
tgcagcccccgcaagacgggcagcccccgcaagacgctgggaccacagcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccaggtcagccagagcagcctccccatgctgtcctcgccgtcaccgggccagcaggtgcagaccccgcagtcgatgccccctcccccccagccgtccccgcagcccggccagcccagctcacagcccaactccaacgtcagctctggccctgccccatctcccagtagcttcctgcccagcccctcaccgcagccctcccagagcccagtgacggcgcggaccccacagaacttcagtgtcccctcacctggacctttaaacacacctgtgaaccccagctctgtcatgagcccagctggctccagccaggctgaggagcagcagtacctggacaagctgaagcagctgtcgaagtacatcgagcccctgcgccgcatgatcaacaagatcgacaagaacgaagacagaaaaaaggacctgagtaagatgaagagccttctggacattctgacagacccctcgaagcggtgtcccctgaagaccttgcaaaagtgtgagatcgccctggagaaactcaagaatgacatggcggtgcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctggatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcacccctactcgttcctatagaacacagaggacataggaaacccttaaaacacacatgggattctctggtcacagttttgggttcaggctatgctgctttgggcaggtggagcaccccccgaggaagcctgcaagtccagggcacaggctgccttttggagggagggctggcccataggtgctgctggctccccgccaccagctgggcctcagccctcacggcattcctgctgagcaccgtggggcacccagggagcaggggcgtcagggatcctgctgccggcacccctgtgccgctggcatgagggccgtgtccccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctgtgttaaaaaaaaaaaaaaaaaaaaaaaaaaaaaaaaaaaaaaaaaaaaaaaaaaaaagggggggccatcccccggaggggcgcccaagttttagcggttcccccagttttttgtgtcaaaagggagcccccattgaggagagcactatttatatacaccagaggagcgggcccgctgttattaaaagggcctggtgaagtgtggaaaacgagttagacggtggacctcttgggggaggagaacccttaacttgctggtggggtggacacattatgtgggcccacacatccctaaagagaatatttaagagcccttaagagaaacaatataaaattctcgaagggttatcaatggtggattaacaccaagcggcgcatatagtctggccagctgagagaagttggcctccggagattattattggaacaatttttttctaccgggggctatggtgtaatac

SEQ ID NO: 368900 - DNA, 3164 bp, Homo sapiens
tgcagcccccgcaagacgggcagcccccgcaagacgctgggaccacagcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccaggtcagccagagcagcctccccatgctgtcctcgccgtcaccgggccagcaggtgcagaccccgcagtcgatgccccctcccccccagccgtccccgcagcccggccagcccagctcacagcccaactccaacgtcagctctggccctgccccatctcccagtagcttcctgcccagcccctcaccgcagccctcccagagcccagtgacggcgcggaccccacagaacttcagtgtcccctcacctggacctttaaacacacctgtgaaccccagctctgtcatgagcccagctggctccagccaggctgaggagcagcagtacctggacaagctgaagcagctgtcgaagtacatcgagcccctgcgccgcatgatcaacaagatcgacaagaacgaagacagaaaaaaggacctgagtaagatgaagagccttctggacattctgacagacccctcgaagcggtgtcccctgaagaccttgcaaaagtgtgagatcgccctggagaaactcaagaatgacatggcggtgcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctggatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcacccctactcgttcctatagaacacagaggacataggaaacccttaaaacacacatgggattctctggtcacagttttgggttcaggctatgctgctttgggcaggtggagcaccccccgaggaagcctgcaagtccagggcacaggctgccttttggagggagggctggcccataggtgctgctggctccccgccaccagctgggcctcagccctcacggcattcctgctgagcaccgtggggcacccagggagcaggggcgtcagggatcctgctgccggcacccctgtgccgctggcatgagggccgtgtccccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctgtgtttgtcagttgttcaaaaaagtgt

SEQ ID NO: 368901 - DNA, 3963 bp, Homo sapiens
tgcagcccccgcaagacgggcagcccccgcaagacgctgggaccacagcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccaggtcagccagagcagcctccccatgctgtcctcgccgtcaccgggccagcaggtgcagaccccgcagtcgatgccccctcccccccagccgtccccgcagcccggccagcccagctcacagcccaactccaacgtcagctctggccctgccccatctcccagtagcttcctgcccagcccctcaccgcagccctcccagagcccagtgacggcgcggaccccacagaacttcagtgtcccctcacctggacctttaaacacacctgtgaaccccagctctgtcatgagcccagctggctccagccaggctgaggagcagcagtacctggacaagctgaagcagctgtcgaagtacatcgagcccctgcgccgcatgatcaacaagatcgacaagaacgaagacagaaaaaaggacctgagtaagatgaagagccttctggacattctgacagacccctcgaagcggtgtcccctgaagaccttgcaaaagtgtgagatcgccctggagaaactcaagaatgacatggcggtgcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctgggtgagtgtccagagggccgggactggtgtgggaaagcaggccctgaccgcagccccaggactctgccatccaagccagatggcacagcgcccagaacccaccctgtgttcacgccccgccaggctgtctgctctatcctcacacacaccgggctccagacagcctggccatgcctcagtccccactgccagagcccgcacactctcacctccccaacacagatgtggctttgcttgcctgggccctagggaggtggtaggcaggacctctgggcacccatcaatgcagagcactccaggcttcacgtttggaaatctgagagtcagagagacctcctccaggctttgccacaagcttcaccagaacctccctgggtgtggagtcctgttccagagcagggctgtgaggcagggcaggccggggcttgtccaggtcacagatagagccttctgtgttgcagatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcacccctactcgttcctatagaacacagaggacataggaaacccttaaaacacacatgggattctctggtcacagttttgggttcaggctatgctgctttgggcaggtggagcaccccccgaggaagcctgcaagtccagggcacaggctgccttttggagggagggctggcccataggtgctgctggctccccgccaccagctgggcctcagccctcacggcattcctgctgagcaccgtggggcacccagggagcaggggcgtcagggatcctgctgccggcacccctgtgccgctggcatgagggccgtgtccccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctgtgaaaacacacagaagaagagaacgagcaacacacgccagaaaaacagaacagaacagaacaagcagggcgggcgacacgcagagagagtacgcccagagcgggcagacacacgtagacacgcaaccaaggatatgtcgagaaacaaagggagcccccgagagaagagaagcgatgatgtatctatcagacacgctgtcgagacggcgagtgctgtgtattatcacggcgttggcagaggcggatacaaaggttaacgaggggaagaactttagttaggaggacgatacttgtattcggagaggagggaagaaaaatggggggacatgtacgtaaggaggaagtgtgacgctttaggtgagatat

SEQ ID NO: 368902 - DNA, 3188 bp, Homo sapiens
tgcagcccccgcaagacgggcagcccccgcaagacgctgggaccacagcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccaggtcagccagagcagcctccccatgctgtcctcgccgtcaccgggccagcaggtgcagaccccgcagtcgatgccccctcccccccagccgtccccgcagcccggccagcccagctcacagcccaactccaacgtcagctctggccctgccccatctcccagtagcttcctgcccagcccctcaccgcagccctcccagagcccagtgacggcgcggaccccacagaacttcagtgtcccctcacctggacctttaaacacacctgtgaaccccagctctgtcatgagcccagctggctccagccaggctgaggagcagcagtacctggacaagctgaagcagctgtcgaagtacatcgagcccctgcgccgcatgatcaacaagatcgacaagaacgaagacagaaaaaaggacctgagtaagatgaagagccttctggacattctgacagacccctcgaagcggtgtcccctgaagaccttgcaaaagtgtgagatcgccctggagaaactcaagaatgacatggcggtgcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctggatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgcccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctgtgttaaaaaaaaaaaaaaaaaaaaaaaaaaaaaaaaaaaaaaaaaaaaaaaaaaagaaaacaagaaaaaaaaagaagaggggcggcggcgccctcaagaagattcgtccgccggaggagagccaccaaatgtgcgacacgacccccatttttgttgtcaaagaggggcccccacaaagggaggccgctattaagaaggcggagcgaagggccgccgacgatttaaaacacagacggcccggacggggggaaagacaccggctcgcctccgggaggagaaccctccgaggagaaaggagggcacccctaccatctctgtgggcggggggcggccaacaactactggggcggcgcacaacatctcaccacccaccagagagcgatagtactactaaacgcccctctacaaggggagcgacatatatctatatcaacatatctttaccaaggcgagtgcatatataaatctgcgggcgcaaaacacacctcaagcgcagaagaattatcttgcctcgtcgccggcgtacgtagaagcaaattatactcttctcgctccaaccaacccggaggatacttcaatctcgtattgacagcacaaacattttt

SEQ ID NO: 368903 - DNA, 1422 bp, Homo sapiens
tgcagcccccgcaagacgggcagcccccgcaagacgctgggaccacagcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccaggtgagggcctgggggtggagggctccatagtcatcagcaggtgcatgttcacctgcgcatgtagtgctacagtgagggttctggttggattaggggctgggggctaagttggtaaagcaggggcttctctcccccttgcactctgcaagacacccctggagtccttggggtgggcagctgtgcttggtcatgtctaggacccaccagccgcatagtgcgtgtcgtttccagctttgctcgggcatccttcattatccctcttccttgccactctgagtgactctgggaac

SEQ ID NO: 368904 - DNA, 548 bp, Homo sapiens
aaaataacacagaaaaactgataacatgccacgacatgggcgaactcgtaaatattatgctaaagaagctagtcacaaaagagcacatgttcgatgccattcgtacaaagagtccggaagtggccaatccatagagacagagaggagattactgattgccagagtctaggcttcttatttatccaaaagacttagttgtcccttttcttttgtctttggttattatagagtaactcatgataggaaatcccaaaatcaacacaaatgctacttcgtattctatctttctgtctgtggtaaatggaacgttcagattccagcggcagccgtggcagtggggcttttgctggctgttttgtcccttgctgtgcagccctgcagcgtttctgggaatctgccctgtggactgactggcgactctggtcttttctcagcccagctgcagctccagcaggtggcgctgcagcagcagcagcaacagcagcagttccagcagcagcagcaggcggcgctacagcagcagcagcagcagcagcaacagcagcagt

SEQ ID NO: 368905 - DNA, 502 bp, Homo sapiens
atccctgccattgatgagctctcaggacttacagttctgtgtatgttttggcttttgttatagttgtttgaatgcatatctgtctctcctgttaggttgccagcttcttgaagaataaaattttatcagcatattttatttatattatatggacaattatatttctatatttttttgctatgccccaccatatctaattttacatatgggacctgtaagattttgatccttctcctaaaatgtttttggtaaatgctgatctcctgtgagagccacctgagtgaggaatctcaatgtgtaggaaagtgagacattctttaatgagagactggaagagtttggttgttaagtgggctcagaaaatgtctgttgtggcaagcctgtggccccatctactcaggatactgaggttggaggatcacttggacccaggagattgaggctatagtgagccatgattgcacctctgcactctagcctgggtgaaaaagtgagactgtct

SEQ ID NO: 368906 - DNA, 486 bp, Homo sapiens
aaggccacctcattagtgctcctgacactgcggaacttttctttctcaaggctgttgtcactggggatggttgaaagtgactattttcctaagaaaacagctggaggggacatgggagcaagaaggtgcttgggagcgcatctcagtgttgaggctcaaaacaggcagcgccatggcagagtcattccgccgtcaccctgaataaaccccaaccccagctccttcctcagggtgtcgtagcacagggatgcttttggtctaattcaggagagcatcatgtgatatgcttttaaagtaatgagttaaaatgttagacaatatgaaactctattatgtgatatattagatttcatgtcattacattgtattatattatatttttaggtggtatgctatgtgacataggatgcgatgtgatattacatcccatgacactatgttacacagtgttggattaaatgcctgtgtctctggctagactgtgag

SEQ ID NO: 368907 - DNA, 540 bp, Homo sapiens
agcttaatggttatgagcagggactctggagtcctcgattcaagtcctgacatcgtaagtaagataactgatgtattatttaaccatcctgagccttagtttccttatctataagatagggataataatacctgtgtctcagaggtgttaaggctcaaggggaaacctatgtagtatgtaacacaggacgctcacaggaggtgttcagtatatcggctatcagattttacaggaccaaccagacggggggtcataaagctgggctgaatttgaagtgaatttgccaaaaacggaggctgctctgcagaagtatcatgggccagagcatattgtttcttgcagaaaacaatatggaaggttctgtgtatgtatctagaaggttaggtttatgtatcttgcaggagtcatttgtcactttctaggatgttattccttctggctttgttttagtttctttttaaatgagtaactggccacaatcatgtatacacacattcacaatgacttttctcaacttggtcaattaaattgcctcttcaa

SEQ ID NO: 368908 - DNA, 264 bp, Homo sapiens
attatatcactggtattctttttcatttaactatatgtgaacattttgccatttctttaaaaaatattcacaaacatcattttaatgcctgaatggtatttcatttagatacaaattagttaagtatgtatatattaataattctccattgtccgtttaggacatgtgacacatccatttaggaactcattttggtgtctttagtttcctgctattataaataatactgtgggccaggcgcagtggcttaggcctgtaatccca

SEQ ID NO: 368909 - DNA, 294 bp, Homo sapiens
gatactatgcttttcccatggtcttcacaacttgcaggccaggagattcccttgggtgcctatgccaccagggccctgagtttcaagcacaaaactgggcagccgtttgggcggacactgagctagctgcaagagttttctttttttcataacccagtggtgcctggaatgccagcgagacagaaccgttcactcccctggaaaggggctgaagccagggagccaagtgatctagctcagcgatcctacggatcctacgaccgcagagcccagcaagctaagatccattggctt

SEQ ID NO: 368910 - DNA, 412 bp, Homo sapiens
taacaaaattgaccatcttaaccatttaagtgtacagttcagtggtaattacactcacgttgttgtacaacccatctttagaacttccaacaggaatacttttgtccagtgatatttacaaacatctctgatatctccttggggtagcaggttcccagcagtggaattacaaaaagaagtacaaaataatgaaagtattgagtccctctataccccgcaaaagacaaccacttttgatggtcgctcctgctttgtttctatagtacgtaaccaacagtaacacatttgcccattcccccagcattggacaggtaagaggtcccctgttttctgctaaaaaataacattcttgtatattaagatttaaaggcatctctgatatttttatcagactatgaaagtgagtttactg

SEQ ID NO: 368911 - DNA, 150 bp, Homo sapiens
atgaataatcttttccctattataaaagtaatatgtgttttttctagaaaacctggaaaatacaaccagcaacaatgcagtcctcagaattaactgctattaatatattttcttctatggatattgaagaaaatatattgttttcaccta

SEQ ID NO: 368912 - DNA, 370 bp, Homo sapiens
gtaaaacttcatttctactaaaaacacaaaaatcagccaggtgtggtggcacgtgcctgtaatcccagctactcaggagactgaggcaggagaatcacttgaacccgggaggcagaggttgcagtgagctgagatcacaccactgcactccagcctgggcgacacagcaagactccacctcaaaaaaataaaaaataaataaataaataaaagacggaaaagctatgttcttaacatttttgaaatgataattcatactaaaaaatgttaccaatattaatgcacaaagcattttataagttttagactattaataaaagatactaaaactgaatttaagtatttgtagccataattaacactataagtt

SEQ ID NO: 368913 - DNA, 410 bp, Homo sapiens
ctcagcctcccaagtagctgggactacagacacctgccaccacacccggctaattttttgtatttttagtagagacagggtttcaccgtgttagtgaggatgatatcaatctcttgacctcgtgatccacccgcctcggcctcccaaagtgctgggattacaggcgtaagccaccgtgcccagcctccctggcctattttcttagagagagggtctcaccatgttgctcaggttggtctcaaactcctgccctttagtgatcctcttgcctcagcctcctgaatagctgggattatactcatgagctatagcactcagctggatcgggggggttaaacacaacctctaaccaatgactgaccaccaagctatgctgacccacagacaatccctactaggccaggttttac

SEQ ID NO: 368914 - DNA, 240 bp, Homo sapiens
tttacatttgactcattaaacaagtagagagatgttcacacatctcaactaatagtaataggtaatttttaaatgatgtttacttgtaagtaatgtgtcagtaagcatcagcaaaaaatgttactttagagatatttaatcatttagtttaatgccatcctttctcttctttcatgtactcagcaaaatcatattcagcagttactatgtggcaacactatgtggcaacaatggaaatct

SEQ ID NO: 368915 - DNA, 908 bp, Homo sapiens
attttagcagggagtttcagcagccaggcttgcagagaattacttacattcttgcagcaatgttatgtgccctgagtgctttttctctctggcctctcaactctgttttaatgggatatgacaagaataacccaatttgtgtaaacttccatagtgcaattattgtttacttctttgactagcctaactcttcattttgtgtagagaaccagacattttatttaggtgctttagataatgtctatcactttgtctcccatatagagcctatgtaatactttgcacatggagatatctcataagaacttggaaaatgtttcttcctttttgaaatgattctttatattttaatggtgcttgttagctacaaggaagtaaataatatttggctaatgatactgtggtctagagtagaagatatgtgtctgtgtgaatgctgtcaattatagatcttcctaatacctttgactctggggtgggacagcccatgtgcaaggagagatactgctaaggaagatactagcaacatctgtgtttaaaatgaagttgtcatctcatgtgtgtgtcaagcagatatgcatcctctatttaccactagagagcctgaaggacagaaaatgagagcaagtgggaatgcagcactaggtacctggagccagatggctgtggagttgaggaagtccctgaacatagcactttgttcctggcagcggggattattggggttaagtttaaatctcatcttgtctcttcttttagatcatgaattccttgaaaataaggataatgtgttacacttttttgtttcccaaatggcttgaaatagttctttaaacataggcacatattcaaccactattaaatgatttggcccttgtcttgtttgctacttttttctcttactctag

SEQ ID NO: 368916 - DNA, 1938 bp, Homo sapiens
ccgctttatttctctgcgagcatcactaaattctgctgtcatcaagagcagatatatagtagttgactcagtaagtgtaaatgctcagaataagttaaatatgtggttacagtttttgtttaacatccaggtacagctatggatgcacttaatagcatgcagaatttcttacggggtcgtcctaaaaccttcaagtctctggagaatgctattgaatggagtgtgaagagtggccagattcgaaatctggagtctgcccgtgtctcaatggttggccaagtcaaacagtgtgaaggaattacaagtccagaaggctcaaaatctatagtggaaggaatcatagaggaagaagaagaagatgaggaaggaagtgagtctataagcaagaggaaaaaggaagatgacatggagaccaagaaagaccatccatacacctggagaattgaactggcaaaaacagaaaaatactgggacggctggttccgaggcttatccaatctctttcttagttgtcccattcctaaattgctgctcttggctggtgttgatagattggataaagatctgaccattggccagatgcaagggaagttccagatgcaggtcctaccccagtgtggccatgcagtccatgaggatgcccctgacaaggtagctgaagctgttgccactttcctgatccggcacaggtttgcagaacccatcggtggattccagtgtgtgtttcctggctgttagtgacctgctgtccacccctcctcaacatcgagctctgttgtaaatacgtcgcaccagaggccactgtgatgccactgtctcctctccatcccgcccagccatgtgacactggctcccggtagacgggcaccccgagatgtaccaaccttttcatgtattctgccaaaagcattgttttccagggcccttgaccaacatcggcttccccagtccagggctcccctgctcctttcccttccctgtactggggtagctcctgcctgctctccctgcgttgcctagggtaaagcctccagatttgccatactgagcccctcttcctagcatcaggcgatacatctgagttcaaatgtcttcccaggctcagggacctccattccttgagattgtcttggcatggcccagccctgcctcatgggatggacaatgcatggggtggtctttatttttccctttcaaataaaacactagtcaggtaccgttttatcccagtcgtactcttccaggtttggaagacccagagaggccaagatcccatccttagccatagcgagcggtggtggtggatagcatcacaagaaacgagcctgaaaatcaggtccagccggtccaagcacatggcctcccatctgggagagcccactgtcccactcccacatgtctgggcacctgccctgggctgaggccaggctgctccaggggcctcctgcgccctcacctgccacagagcaacccaggttaaatacagcccatgcacaaagccacaggccaaagcctatggaattgtttttaatcatcaaatttaaccattttcataactggttcctggaggtgtgcagtgcccccttgcctcttcaaacctacagcttctctttgccatttgtggatttcacatcactccacacagaaacattacagcctggcatccccagtctttgccttcttccagctgcctcgacacagcactgtggcctgtccctattgcccaggcacgccatttccaagggcaggaaggggcagtgtcctgaagcccatcttttctgtgactgtcttaggtgatgtgtagccccctccacctttccactcaacaacctcccacccctgtcctgctgcatggtccggagtctgggacctactttgttttttgttatttatgaccttgtttaaagaaaataaatatctcccaacctttaaaaaaat

SEQ ID NO: 368917 - DNA, 1056 bp, Homo sapiens
attttagcagggagtttcagcagccaggcttgcagagaattacttacattcttgcagcaatgttatgtgccctgagtgctttttctctctggcctctcaactctgttttaatgggatatgacaagaataacccaatttgtgtaaacttccatagtgcaattattgtttacttctttgactagcctaactcttcattttgtgtagagaaccagacattttatttaggtgctttagataatgtctatcactttgtctcccatatagagcctatgtaatactttgcacatggagatatctcataagaacttggaaaatgtttcttcctttttgaaatgattctttatattttaatggtgcttgttagctacaaggaagtaaataatatttggctaatgatactgtggtctagagtagaagatatgtgtctgtgtgaatgctgtcaattatagatcttcctaatacctttgactctggggtgggacagcccatgtgcaaggagagatactgctaaggaagatactagcaacatctgtgtttaaaatgaagttgtcatctcatgtgtgtgtcaagcagatatgcatcctctatttaccactagagagcctgaaggacagaaaatgagagcaagtgggaatgcagcactaggtacctggagccagatggctgtggagttgaggaagtccctgaacatagcactttgttcctggcagcggggattattggggttaagtttaaatctcatcttgtctcttcttttagatcatgaattccttgaaaataaggataatgtgttacacttttttgtttcccaaatggcttgaaatagttctttaaacataggcacatattcaaccactattaaatgatttggcccttgtcttgtttgctacttttttctcttactctaggataaattgtgtgacttgtccataagtaccaggctctgtcatgtctctggaccagtactgtccaatagaaatagagtgcaaaccacgtatgtcattttaaatttcttagtagacactttaaatagataaaaagaaacaataaattaat

SEQ ID NO: 368918 - DNA, 717 bp, Homo sapiens
gtgaaagtcgtcgggttcccagccgggagtctgcggagttctcatactctgttacccagcttcctttgtatgagtgctgttgcgcacttccggtggaagcgctgaagcgagtgggtggagtttacggagccggtgggcggtaggcggtgctacgggtagctgggtgctgtccaaaggcgacagggcgtcgttaggggagcgagtcgtgaccggttgggccacactcaacgtgggacgaagcttcgcctactgtttgactacgtgcgtgcagcctcccctcgatgtcggccctcgaaaagagcatgcacctcggccgccttccctctcgcccacctctacccggcagcgggggcagtcagagcggagccaagatgcgaatgggccctggaagaaagcgggacttttcccctgttccttggagtcagtattttgagtccatggaagatgtagaagtagagaatgaaactggcaaggatacttttcgagtctacaagagtggttcagagggtccagtcctgctccttctgcatggaggaggtcattctgccctttcttgggctgtgttcacggataaattgtgtgacttgtccataagtaccaggctctgtcatgtctctggaccagtactgtccaatagaaatagagtgcaaaccacgtatgtcattttaaatttcttagtagacactttaaatagataaaaagaaacaataaattaat

SEQ ID NO: 368919 - DNA, 221 bp, Homo sapiens
caaatttcgttgaccccatttgagctaccccacaccatggaggtggggcctcaatttaaggccttccctgtagaagggggttgtggcaaaaacctccctttacgatcaacaacctcccacccctgtcctgctgcatggtccggagtctgggacctactttgttttttgttatttatgaccttgtttaaagaaaataaatatctcccaacctttaaaaaaat

SEQ ID NO: 368920 - DNA, 2642 bp, Homo sapiens
gtgaaagtcgtcgggttcccagccgggagtctgcggagttctcatactctgttacccagcttcctttgtatgagtgctgttgcgcacttccggtggaagcgctgaagcgagtgggtggagtttacggagccggtgggcggtaggcggtgctacgggtagctgggtgctgtccaaaggcgacagggcgtcgttaggggagcgagtcgtgaccggttgggccacactcaacgtgggacgaagcttcgcctactgtttgactacgtgcgtgcagcctcccctcgatgtcggccctcgaaaagagcatgcacctcggccgccttccctctcgcccacctctacccggcagcgggggcagtcagagcggagccaagatgcgaatgggccctggaagaaagcgggacttttcccctgttccttggagtcagtattttgagtccatggaagatgtagaagtagagaatgaaactggcaaggatacttttcgagtctacaagagtggttcagagggtccagtcctgctccttctgcatggaggaggtcattctgccctttcttgggctgtgttcacggcagcgattattagtagagttcagtgtaggattgtagctttggatctgcgaagtcatggtgaaacaaaggtcaagaatcctgaagatctgtctgcagaaacaatggcaaaagacgttggcaatgtggttgaagccatgtatggggaccttcctcctccaattatgctgattggacatagcatgggtggtgctattgcagtccacacagcatcatccaacctggtaccaagcctcttgggtctgtgcatgattgatgttgtagaaggtacagctatggatgcacttaatagcatgcagaatttcttacggggtcgtcctaaaaccttcaagtctctggagaatgctattgaatggagtgtgaagagtggccagattcgaaatctggagtctgcccgtgtctcaatggttggccaagtcaaacagtgtgaaggaattacaagtccagaaggctcaaaatctatagtggaaggaatcatagaggaagaagaagaagatgaggaaggaagtgagtctataagcaagaggaaaaaggaagatgacatggagaccaagaaagaccatccatacacctggagaattgaactggcaaaaacagaaaaatactgggacggctggttccgaggcttatccaatctctttcttagttgtcccattcctaaattgctgctcttggctggtgttgatagattggataaagatctgaccattggccagatgcaagggaagttccagatgcaggtcctaccccagtgtggccatgcagtccatgaggatgcccctgacaaggtagctgaagctgttgccactttcctgatccggcacaggtttgcagaacccatcggtggattccagtgtgtgtttcctggctgttagtgacctgctgtccacccctcctcaacatcgagctctgttgtaaatacgtcgcaccagaggccactgtgatgccactgtctcctctccatcccgcccagccatgtgacactggctcccggtagacgggcaccccgagatgtaccaaccttttcatgtattctgccaaaagcattgttttccagggcccttgaccaacatcggcttccccagtccagggctcccctgctcctttcccttccctgtactggggtagctcctgcctgctctccctgcgttgcctagggtaaagcctccagatttgccatactgagcccctcttcctagcatcaggcgatacatctgagttcaaatgtcttcccaggctcagggacctccattccttgagattgtcttggcatggcccagccctgcctcatgggatggacaatgcatggggtggtctttatttttccctttcaaataaaacactagtcaggtaccgttttatcccagtcgtactcttccaggtttggaagacccagagaggccaagatcccatccttagccatagcgagcggtggtggtggatagcatcacaagaaacgagcctgaaaatcaggtccagccggtccaagcacatggcctcccatctgggagagcccactgtcccactcccacatgtctgggcacctgccctgggctgaggccaggctgctccaggggcctcctgcgccctcacctgccacagagcaacccaggttaaatacagcccatgcacaaagccacaggccaaagcctatggaattgtttttaatcatcaaatttaaccattttcataactggttcctggaggtgtgcagtgcccccttgcctcttcaaacctacagcttctctttgccatttgtggatttcacatcactccacacagaaacattacagcctggcatccccagtctttgccttcttccagctgcctcgacacagcactgtggcctgtccctattgcccaggcacgccatttccaagggcaggaaggggcagtgtcctgaagcccatcttttctgtgactgtcttaggtgatgtgtagccccctccacctttccactcaacaacctcccacccctgtcctgctgcatggtccggagtctgggacctactttgttttttgttatttatgaccttgtttaaagaaaataaatatctcccaacctttaaaaaaat

SEQ ID NO: 368921 - DNA, 2655 bp, Homo sapiens
gtgaaagtcgtcgggttcccagccgggagtctgcggagttctcatactctgttacccagcttcctttgtatgagtgctgttgcgcacttccggtggaagcgctgaagcgagtgggtggagtttacggagccggtgggcggtaggcggtgctacgggtagctgggtgctgtccaaaggcgacagggcgtcgttaggggagcgagtcgtgaccggttgggccacactcaacgtgggacgaagcttcgcctactgtttgactacgtgcgtgcagcctcccctcgatgtcggccctcgaaaagagcatgcacctcggccgccttccctctcgcccacctctacccggcagcgggggcagtcagagcggagccaagatgcgaatgggccctggaagaaagcgggacttttcccctgttccttggagtcagtattttgagtccatggaagatgtagaagtagagaatgaaactggcaaggatacttttcgagtctacaagagtggttcagagggtccagtcctgctccttctgcatggaggaggtcattctgccctttcttgggctgtgttcacgcagcgacttatcagtacgagttcagtgtaggactcgtacgcttcggatctgcgacagctcatggtgaaacaaaggtccaacacctcctgccacgatctgcctgcacaaaccatggccacacgacgtctgcgcaccgcggctcgacgccatgtatggggaccttcctcctccaattatgctgattggacatagcatgggtggtgctattgcagtccacacagcatcatccaacctggtaccaagcctcttgggtctgtgcatgattgatgttgtagaaggtacagctatggatgcacttaatagcatgcagaatttcttacggggtcgtcctaaaaccttcaagtctctggagaatgctattgaatggagtgtgaagagtggccagattcgaaatctggagtctgcccgtgtctcaatggttggccaagtcaaacagtgtgaaggaattacaagtccagaaggctcaaaatctatagtggaaggaatcatagaggaagaagaagaagatgaggaaggaagtgagtctataagcaagaggaaaaaggaagatgacatggagaccaagaaagaccatccatacacctggagaattgaactggcaaaaacagaaaaatactgggacggctggttccgaggcttatccaatctctttcttagttgtcccattcctaaattgctgctcttggctggtgttgatagattggataaagatctgaccattggccagatgcaagggaagttccagatgcaggtcctaccccagtgtggccatgcagtccatgaggatgcccctgacaaggtagctgaagctgttgccactttcctgatccggcacaggtttgcagaacccatcggtggattccagtgtgtgtttcctggctgttagtgacctgctgtccacccctcctcaacatcgagctctgttgtaaatacgtcgcaccagaggccactgtgatgccactgtctcctctccatcccgcccagccatgtgacactggctcccggtagacgggcaccccgagatgtaccaaccttttcatgtattctgccaaaagcattgttttccagggcccttgaccaacatcggcttccccagtccagggctcccctgctcctttcccttccctgtactggggtagctcctgcctgctctccctgcgttgcctagggtaaagcctccagatttgccatactgagcccctcttcctagcatcaggcgatacatctgagttcaaatgtcttcccaggctcagggacctccattccttgagattgtcttggcatggcccagccctgcctcatgggatggacaatgcatggggtggtctttatttttccctttcaaataaaacactagtcaggtaccgttttatcccagtcgtactcttccaggtttggaagacccagagaggccaagatcccatccttagccatagcgagcggtggtggtggatagcatcacaagaaacgagcctgaaaatcaggtccagccggtccaagcacatggcctcccatctgggagagcccactgtcccactcccacatgtctgggcacctgccctgggctgaggccaggctgctccaggggcctcctgcgccctcacctgccacagagcaacccaggttaaatacagcccatgcacaaagccacaggccaaagcctatggaattgtttttaatcatcaaatttaaccattttcataactggttcctggaggtgtgcagtgcccccttgcctcttcaaacctacagcttctctttgccatttgtggatttcacatcactccacacagaaacattacagcctggcatccccagtctttgccttcttccagctgcctcgacacagcactgtggcctgtccctattgcccaggcacgccatttccaagggcaggaaggggcagtgtcctgaagcccatcttttctgtgactgtcttaggtgatgtgtagccccctccacctttccactcaacaacctcccacccctgtcctgctgcatggtccggagtctgggacctactttgttttttgttatttatgaccttgtttaaagaaaataaatatctcccaacctttaaaaaaat

SEQ ID NO: 368922 - DNA, 2589 bp, Homo sapiens
gtgaaagtcgtcgggttcccagccgggagtctgcggagttctcatactctgttacccagcttcctttgtatgagtgctgttgcgcacttccggtggaagcgctgaagcgagtgggtggagtttacggagccggtgggcggtaggcggtgctacgggtagctgggtgctgtccaaaggcgacagggcgtcgttaggggagcgagtcgtgaccggttgggccacactcaacgtgggacgaagcttcgcctactgtttgactacgtgcgtgcagcctcccctcgatgtcggccctcgaaaagagcatgcacctcggccgccttccctctcgcccacctctacccggcagcgggggcagtcagagcggagccaagatgcgaatgggccctggaagaaagcgggacttttcccctgttccttggagtcagtattttgagtccatggaagatgtagaagtagagaatgaaactggcaaggatacttttcgagtctacaagagtggttcagagggtccagtcctgctccttctgcatggaggaggtcattctgccctttcttgggctgtgttcacggcagcgattattagtagagttcagtgtaggattgtagctttggatctgcgaagtcatggtgaaacaaaggtcaagaatcctgaagatctgtctgcagaaacaatggcaaaagacgttggcaatgtggttgaagccatgtatggggaccttcctcctccaattatgctgattggacatagcatgggtggtgctattgcagtccacacagcatcatccaacctggtaccaagcctcttgggtctgtgcatgattgatgttgtagaaggtacagctatggatgcacttaatagcatgcagaatttcttacggggtcgtcctaaaaccttcaagtctctggagaatgctattgaatggagtgtgaagagtggccagattcgaaatctggagtctgcccgtgtctcaatggttggccaagtcaaacagtgtgaaggaattacaagtccagaaggctcaaaatctatagtggaaggaatcatagaggaagaagaagaagatgaggaaggaagtgagtctataagcaagaggaaaaaggaagatgacatggagaccaagaaagaccatccatacacctggagaattgaactggcaaaaacagaaaaatactgggacggctggttccgaggcttatccaatctctttcttagttgtcccattcctaaattgctgctcttggctggtgttgatagattggataaagatctgaccattggccagatgcaagggaagttccagatgcaggtcctaccccagtgtggccatgcagtccatgaggatgcccctgacaaggtagctgaagctgttgccactttcctgatccggcacaggtttgcagaacccatcggtggattccagtgtgtgtttcctggctgttagtgacctgctgtccacccctcctcaacatcgagctctgttgtaaatacgtcgcaccagaggccactgtgatgccactgtctcctctccatcccgcccagccatgtgacactggctcccggtagacgggcaccccgagatgtaccaaccttttcatgtattctgccaaaagcattgttttccagggcccttgaccaacatcggcttccccagtccagggctcccctgctcctttcccttccctgtactggggtagctcctgcctgctctccctgcgttgcctagggtaaagcctccagatttgccatactgagcccctcttcctagcatcaggcgatacatctgagttcaaatgtcttcccaggctcagggacctccattccttgagattgtcttggcatggcccagccctgcctcatgggatggacaatgcatggggtggtctttatttttccctttcaaataaaacactagtcaggtaccgttttatcccagtcgtactcttccaggtttggaagacccagagaggccaagatcccatccttagccatagcgagcggtggtggtggatagcatcacaagaaacgagcctgtgtcccactcccacatgtctgggcacctgccctgggctgaggccaggctgctccaggggcctcctgcgccctcacctgccacagagcaacccaggttaaatacagcccatgcacaaagccacaggccaaagcctatggaattgtttttaatcatcaaatttaaccattttcataactggttcctggaggtgtgcagtgcccccttgcctcttcaaacctacagcttctctttgccatttgtggatttcacatcactccacacagaaacattacagcctggcatccccagtctttgccttcttccagctgcctcgacacagcactgtggcctgtccctattgcccaggcacgccatttccaagggcaggaaggggcagtgtcctgaagcccatcttttctgtgactgtcttaggtgatgtgtagccccctccacctttccactcaacaacctcccacccctgtcctgctgcatggtccggagtctgggacctactttgttttttgttatttatgaccttgtttaaagaaaataaatatctcccaacctttaaaaaaat

SEQ ID NO: 368923 - DNA, 1608 bp, Homo sapiens
agggcctgggagatgagagtgacagggcagggtaagcactggagatgatggcaagaccttgggacagtgaaccacagaagcgacacccctatgctgagccatccctctaacaactgaccattcatggatcccaggaaccaacaataaagacttaatttctcttactaaacagtgtttggctggggcccttcgaccatttggagccttgggcaaatgagcagcacactgagagcagaccctgggtccagctctggtcagggctgtgaaatgggtcagatttgccagggccttggtggtcattagggagggcttcctggaggatacagataagcaagggaaagctattgatagttacatttgtttttccttctctttctgttcttccacagtgtgtttcctggctgttagtgacctgctgtccacccctcctcaacatcgagctctgttgtaaatacgtcgcaccagaggccactgtgatgccactgtctcctctccatcccgcccagccatgtgacactggctcccggtagacgggcaccccgagatgtaccaaccttttcatgtattctgccaaaagcattgttttccagggcccttgaccaacatcggcttccccagtccagggctcccctgctcctttcccttccctgtactggggtagctcctgcctgctctccctgcgttgcctagggtaaagcctccagatttgccatactgagcccctcttcctagcatcaggcgatacatctgagttcaaatgtcttcccaggctcagggacctccattccttgagattgtcttggcatggcccagccctgcctcatgggatggacaatgcatggggtggtctttatttttccctttcaaataaaacactagtcaggtaccgttttatcccagtcgtactcttccaggtttggaagacccagagaggccaagatcccatccttagccatagcgagcggtggtggtggatagcatcacaagaaacgagcctgaaaatcaggtccagccggtccaagcacatggcctcccatctgggagagcccactgtcccactcccacatgtctgggcacctgccctgggctgaggccaggctgctccaggggcctcctgcgccctcacctgccacagagcaacccaggttaaatacagcccatgcacaaagccacaggccaaagcctatggaattgtttttaatcatcaaatttaaccattttcataactggttcctggaggtgtgcagtgcccccttgcctcttcaaacctacagcttctctttgccatttgtggatttcacatcactccacacagaaacattacagcctggcatccccagtctttgccttcttccagctgcctcgacacagcactgtggcctgtccctattgcccaggcacgccatttccaagggcaggaaggggcagtgtcctgaagcccatcttttctgtgactgtcttaggtgatgtgtagccccctccacctttccactcaacaacctcccacccctgtcctgctgcatggtccggagtctgggacctactttgttttttgttatttatgaccttgtttaaagaaaataaatatctcccaacctttaaaaaaat

SEQ ID NO: 368924 - DNA, 1977 bp, Homo sapiens
gtgaaagtcgtcgggttcccagccgggagtctgcggagttctcatactctgttacccagcttcctttgtatgagtgctgttgcgcacttccggtggaagcgctgaagcgagtgggtggagtttacggagccggtgggcggtaggcggtgctacgggtagctgggtgctgtccaaaggcgacagggcgtcgttaggggagcgagtcgtgaccggttgggccacactcaacgtgggacgaagcttcgcctactgtttgactacgtgcgtgcagcctcccctcgatgtcggccctcgaaaagagcatgcacctcggccgccttccctctcgcccacctctacccggcagcgggggcagtcagagcggagccaagatgcgaatgggccctggaagaaagcgggacttttcccctgttccttggagtcagtattttgagtccatggaagatgtagaagtagagaatgaaactggcaaggatacttttcgagtctacaagagtggttcagagggtccagtcctgctccttctgcatggaggaggtcattctgccctttcttgggctgtgttcacggcagcgattattagtagagttcagtgtaggattgtagctttggatctgcgaagtcatggtgaaacaaaggtcaagaatcctgaagatctgtctgcagaaacaatggcaaaagacgttggcaatgtggttgaagccatgtatggggaccttcctcctccaattatgctgattggacatagcatgggtggtgctattgcagtccacacagcatcatccaacctggtaccaagcctcttgggtctgtgcatgattgatgttgtagaaggtacagctatggatgcacttaatagcatgcagaatttcttacggggtcgtcctaaaaccttcaagtctctggagaatgctattgaatggagtgtgaagagtggccagattcgaaatctggagtctgcccgtgtctcaatggttggccaagtcaaacagggctcccctgctcctttcccttccctgtactggggtagctcctgcctgctctccctgcgttgcctagggtaaagcctccagatttgccatactgagcccctcttcctagcatcaggcgatacatctgagttcaaatgtcttcccaggctcagggacctccattccttgagattgtcttggcatggcccagccctgcctcatgggatggacaatgcatggggtggtctttatttttccctttcaaataaaacactagtcaggtaccgttttatcccagtcgtactcttccaggtttggaagacccagagaggccaagatcccatccttagccatagcgagcggtggtggtggatagcatcacaagaaacgagcctgaaaatcaggtccagccggtccaagcacatggcctcccatctgggagagcccactgtcccactcccacatgtctgggcacctgccctgggctgaggccaggctgctccaggggcctcctgcgccctcacctgccacagagcaacccaggttaaatacagcccatgcacaaagccacaggccaaagcctatggaattgtttttaatcatcaaatttaaccattttcataactggttcctggaggtgtgcagtgcccccttgcctcttcaaacctacagcttctctttgccatttgtggatttcacatcactccacacagaaacattacagcctggcatccccagtctttgccttcttccagctgcctcgacacagcactgtggcctgtccctattgcccaggcacgccatttccaagggcaggaaggggcagtgtcctgaagcccatcttttctgtgactgtcttaggtgatgtgtagccccctccacctttccactcaacaacctcccacccctgtcctgctgcatggtccggagtctgggacctactttgttttttgttatttatgaccttgtttaaagaaaataaatatctcccaacctttaaaaaaat

SEQ ID NO: 368925 - DNA, 1634 bp, Homo sapiens
  misc_feature (1509)..(1509): n is a, c, g, or t
gtgaaagtcgtcgggttcccagccgggagtctgcggagttctcatactctgttacccagcttcctttgtatgagtgctgttgcgcacttccggtggaagcgctgaagcgagtgggtggagtttacggagccggtgggcggtaggcggtgctacgggtagctgggtgctgtccaaaggcgacagggcgtcgttaggggagcgagtcgtgaccggttgggccacactcaacgtgggacgaagcttcgcctactgtttgactacgtgcgtgcagcctcccctcgatgtcggccctcgaaaagagcatgcacctcggccgccttccctctcgcccacctctacccggcagcgggggcagtcagagcggagccaagatgcgaatgggccctggaagaaagcgggacttttcccctgttccttggagtcagtattttgagtccatggaagatgtagaagtagagaatgaaactggcaaggatacttttcgagtctacaagagtggttcagagggtccagtcctgctccttctgcatggaggaggtcattctgccctttcttgggctgtgttcacggcagcgattattagtagagttcagtgtaggattgtagctttggatctgcgaagtcatggtgaaacaaaggtcaagaatcctgaagatctgtctgcagaaacaatggcaaaagacgttggcaatgtggttgaagccatgtatggggaccttcctcctccaattatgctgattggacatagcatgggtggtgctattgcagtccacacagcatcatccaacctggtaccaagcctcttgggtctgtgcatgattgatgttgtagaaggtacagctatggatgcacttaatagcatgcagaatttcttacggggtcgtcctaaaaccttcaagtctctggagaatgctattgaatggagtgtgaagagtggccagattcgaaatctggagtctgcccgtgtctcaatggttggccaagtcaaacagtgtgaaggaattacaagtccagaaggctcaaaatctatagtggaaggaatcatagaggaagaagaagaagatgaggaaggaagtgagtctataagcaagaggaaaaaggaagatgacatggagaccaagaaagaccatccatacacctggagaattgaactggcaaaaacagaaaaatactgggacggctggttccgaggcttatccaatctctttcttagttgtcccattcctaaattgctgctcttggctggtgttgatagattggataaagatctgaccattggccagatgcaagggaagttccagatgcaggtcctaccccagtgtggccatgcagtccatgaggatgcccctgacaaggtagctgaagctgttgccactttcctgatccggcacaggtttgcagaacccatcggtggattccagtgtgtgttatccatgagctgcttaagtgacactgcttgttccaacccgctccgtacaagcatcggagactcatgtatgtacacatacngctcgcaaccaagaaggcacacgtggtgattgcacacttgttcatcactcttccatcgcgcgccgagcccatgttgaacacgtggactcacctggtcatgactggagcacctccaagaggcatgc

SEQ ID NO: 368926 - DNA, 995 bp, Homo sapiens
gtgaaagtcgtcgggttcccagccgggagtctgcggagttctcatactctgttacccagcttcctttgtatgagtgctgttgcgcacttccggtggaagcgctgaagcgagtgggtggagtttacggagccggtgggcggtaggcggtgctacgggtagctgggtgctgtccaaaggcgacagggcgtcgttaggggagcgagtcgtgaccggttgggccacactcaacgtgggacgaagcttcgcctactgtttgactacgtgcgtgcagcctcccctcgatgtcggccctcgaaaagagcatgcacctcggccgccttccctctcgcccacctctacccggcagcgggggcagtcagagcggagccaagatgcgaatgggccctggaagaaagcgggacttttcccctgttccttggagtcagtattttgagtccatggaagatgtagaagtagagaattgcttggacccgggaggcaaaggttgcagtgagtggagatcatgcatgccactgcactccagcctgggcgacaagagcaagattctgtctcaaacaaaacaaaacaaaacaaacaaaaaacttttaaccaggattttttaaaaaaatagtaaactctacctaacacagtatttctcattttaaccatgtggaaatgaacagttcagtggcattaattacattcacaaggctgtggaccacaccactatctataccccaactttttcatcatccccagcaagaactctgtacccattaagcaataactcctgcctgcgtccccaagctctattctgcttttggtctctgaatttgcctattttaggtagctcataggtggaatcctacaatatttattttgtgtctggcttatttcgtttagcataatgctttcaagtccatccatgttgtagtgtgtatcaaaattctgttccattttatggctgaatattttattaaatgcatattccatattttgtttagccattctcttga

SEQ ID NO: 368927 - DNA, 1084 bp, Homo sapiens
gtgaaagtcgtcgggttcccagccgggagtctgcggagttctcatactctgttacccagcttcctttgtatgagtgctgttgcgcacttccggtggaagcgctgaagcgagtgggtggagtttacggagccggtgggcggtaggcggtgctacgggtagctgggtgctgtccaaaggcgacagggcgtcgttaggggagcgagtcgtgaccggttgggccacactcaacgtgggacgaagcttcgcctactgtttgactacgtgcgtgcagcctcccctcgatgtcggccctcgaaaagagcatgcacctcggccgccttccctctcgcccacctctacccggcagcgggggcagtcagagcggagccaagatgcgaatggggtacgtgacccataccccttctccctatgggccaggccccagccgttggagaatggtatctctgggcgttcatagaggcacgggaaaggagtctactgataggagaaaatgttggcggcctggagatatttagatggagtagaaggcagattggggtactaggggaggcgccaagtcaatagaaattggaggaaaaataacgttgttgaagggagaggggaatgaggcaaaggttggggaagctgagagactaacataagggatctgagaatcacttccacaataaaggaggcttagaaaagggagtagaacggtgacaaaggtggaggagaatcggccagggaaggtggagggaagtggggaatgactgagagaaaagttgaggggaattgggccaacaactaaggaaaggtttgggaggagtagatattatcagagttctaatatctgcactgtgagaactagatactagaaaagctgaggggggtagaaaacactcgagacagggctggagaaggaaagaggagaactaggaagcagacgattctagagaattcccagaggtgtaaagacagattcagcgaatgagaggtgagattaggtctcttaagggagaatgagaaagtttagggagtaggcctaaggtaaggtggagaacatagccacgaagattgttaagggtagtaggaatgtgctgagaag

SEQ ID NO: 368928 - DNA, 2207 bp, Homo sapiens
cgacggcagtgaatctgtatcatggtctagcttgttgcctgggttgaagagcaggaggagctaccccagtccaggctctcctgctccttctgcatggaggaggtcattctgccctttcttgggctgtgttcacggcagcgattattagtagagttcagtgtaggattgtagctttggatctgcgaagtcatggtgaaacaaaggtcaagaatcctgaagatctgtctgcagaaacaatggcaaaagacgttggcaatgtggttgaagccatgtatggggaccttcctcctccaattatgctgattggacatagcatgggtggtgctattgcagtccacacagcatcatccaacctggtaccaagcctcttgggtctgtgcatgattgatgttgtagaaggtacagctatggatgcacttaatagcatgcagaatttcttacggggtcgtcctaaaaccttcaagtctctggagaatgctattgaatggagtgtgaagagtggccagattcgaaatctggagtctgcccgtgtctcaatggttggccaagtcaaacagtgtgaaggaattacaagtccagaaggctcaaaatctatagtggaaggaatcatagaggaagaagaagaagatgaggaaggaagtgagtctataagcaagaggaaaaaggaagatgacatggagaccaagaaagaccatccatacacctggagaattgaactggcaaaaacagaaaaatactgggacggctggttccgaggcttatccaatctctttcttagttgtcccattcctaaattgctgctcttggctggtgttgatagattggataaagatctgaccattggccagatgcaagggaagttccagatgcaggtcctaccccagtgtggccatgcagtccatgaggatgcccctgacaaggtagctgaagctgttgccactttcctgatccggcacaggtttgcagaacccatcggtggattccagtgtgtgtttcctggctgttagtgacctgctgtccacccctcctcaacatcgagctctgttgtaaatacgtcgcaccagaggccactgtgatgccactgtctcctctccatcccgcccagccatgtgacactggctcccggtagacgggcaccccgagatgtaccaaccttttcatgtattctgccaaaagcattgttttccagggcccttgaccaacatcggcttccccagtccagggctcccctgctcctttcccttccctgtactggggtagctcctgcctgctctccctgcgttgcctagggtaaagcctccagatttgccatactgagcccctcttcctagcatcaggcgatacatctgagttcaaatgtcttcccaggctcagggacctccattccttgagattgtcttggcatggcccagccctgcctcatgggatggacaatgcatggggtggtctttatttttccctttcaaataaaacactagtcaggtaccgttttatcccagtcgtactcttccaggtttggaagacccagagaggccaagatcccatccttagccatagcgagcggtggtggtggatagcatcacaagaaacgagcctgaaaatcaggtccagccggtccaagcacatggcctcccatctgggagagcccactgtcccactcccacatgtctgggcacctgccctgggctgaggccaggctgctccaggggcctcctgcgccctcacctgccacagagcaacccaggttaaatacagcccatgcacaaagccacaggccaaagcctatggaattgtttttaatcatcaaatttaaccattttcataactggttcctggaggtgtgcagtgcccccttgcctcttcaaacctacagcttctctttgccatttgtggatttcacatcactccacacagaaacattacagcctggcatccccagtctttgccttcttccagctgcctcgacacagcactgtggcctgtccctattgcccaggcacgccatttccaagggcaggaaggggcagtgtcctgaagcccatcttttctgtgactgtcttaggtgatgtgtagccccctccacctttccactcaacaacctcccacccctgtcctgctgcatggtccggagtctgggacctactttgttttttgttatttatgaccttgtttaaagaaaataaatatctcccaacctttaaaaaaat

SEQ ID NO: 368929 - DNA, 2498 bp, Homo sapiens
gtgaaagtcgtcgggttcccagccgggagtctgcggagttctcatactctgttacccagcttcctttgtatgagtgctgttgcgcacttccggtggaagcgctgaagcgagtgggtggagtttacggagccggtgggcggtaggcggtgctacgggtagctgggtgctgtccaaaggcgacagggcgtcgttaggggagcgagtcgtgaccggttgggccacactcaacgtgggacgaagcttcgcctactgtttgactacgtgcgtgcagcctcccctcgatgtcggccctcgaaaagagcatgcacctcggccgccttccctctcgcccacctctacccggcagcgggggcagtcagagcggagccaagatgcgaatgggccctggaagaaagcgggacttttcccctgttccttggagtcagtattttgagtccatggaagatgtagaagtagagaatgaaactggcaaggatacttttcgagtctacaagagtggttcagagggtccagtcctgctccttctgcatggaggaggtcattctgccctttcttgggctgtgttcacggcagcgattattagtagagttcagtgtaggattgtagctttggatctgcgaagtcatggtgaaacaaaggtcaagaatcctgaagatctgtctgcagaaacaatggcaaaagacgttggcaatgtggttgaagccatgtatggggaccttcctcctccaattatgctgattggacatagcatgggtggtgctattgcagtccacacagcatcatccaacctggtaccaagcctcttgggtctgtgcatgattgatgttgtagaaggtacagctatggatgcacttaatagcatgcagaatttcttacggggtcgtcctaaaaccttcaagtctctggagaatgctattgaatggagtgtgaagagtggccagattcgaaatctggagtctgcccgtgtctcaatggttggccaagtcaaacagtgtgaaggaattacaagtccagaaggctcaaaatctatagtggaaggaatcatagaggaagaagaagaagatgaggaaggaagtgagtctataagcaagaggaaaaaggaagatgacatggagaccaagaaagaccatccatacacctggagaattgaactggcaaaaacagaaaaatactgggacggctggttccgaggcttatccaatctctttcttagttgtcccattcctaaattgctgctcttggctggtgttgatagattggataaagatctgaccattggccagatgcaagggaagttccagatgcaggtcctaccccagtgtggccatgcagtccatgaggatgcccctgacaaggtagctgaagctgttgccactttcctgatccggcacaggtttgcagaacccatcggtggattccagtgtgtgtttcctggctgttagtgacctgctgtccacccctcctcaacatcgagctctgttgtaaatacgtcgcaccagaggccactgtgatgggctcccctgctcctttcccttccctgtactggggtagctcctgcctgctctccctgcgttgcctagggtaaagcctccagatttgccatactgagcccctcttcctagcatcaggcgatacatctgagttcaaatgtcttcccaggctcagggacctccattccttgagattgtcttggcatggcccagccctgcctcatgggatggacaatgcatggggtggtctttatttttccctttcaaataaaacactagtcaggtaccgttttatcccagtcgtactcttccaggtttggaagacccagagaggccaagatcccatccttagccatagcgagcggtggtggtggatagcatcacaagaaacgagcctgaaaatcaggtccagccggtccaagcacatggcctcccatctgggagagcccactgtcccactcccacatgtctgggcacctgccctgggctgaggccaggctgctccaggggcctcctgcgccctcacctgccacagagcaacccaggttaaatacagcccatgcacaaagccacaggccaaagcctatggaattgtttttaatcatcaaatttaaccattttcataactggttcctggaggtgtgcagtgcccccttgcctcttcaaacctacagcttctctttgccatttgtggatttcacatcactccacacagaaacattacagcctggcatccccagtctttgccttcttccagctgcctcgacacagcactgtggcctgtccctattgcccaggcacgccatttccaagggcaggaaggggcagtgtcctgaagcccatcttttctgtgactgtcttaggtgatgtgtagccccctccacctttccactcaacaacctcccacccctgtcctgctgcatggtccggagtctgggacctactttgttttttgttatttatgaccttgtttaaagaaaataaatatctcccaacctttaaaaaaat

SEQ ID NO: 368930 - DNA, 2636 bp, Homo sapiens
gtgaaagtcgtcgggttcccagccgggagtctgcggagttctcatactctgttacccagcttcctttgtatgagtgctgttgcgcacttccggtggaagcgctgaagcgagtgggtggagtttacggagccggtgggcggtaggcggtgctacgggtagctgggtgctgtccaaaggcgacagggcgtcgttaggggagcgagtcgtgaccggttgggccacactcaacgtgggacgaagcttcgcctactgtttgactacgtgcgtgcagcctcccctcgatgtcggccctcgaaaagagcatgcacctcggccgccttccctctcgcccacctctacccggcagcgggggcagtcagagcggagccaagatgcgaatgggccctggaagaaagcgggacttttcccctgttccttggagtcagtattttgagtccatggaagatgtagaagtagagaatgaaactggcaaggatacttttcgagtctacaagagtggttcagagggtccagtcctgctccttctgcatggaggaggtcattctgccctttcttgggctgtgttcacggcagcgattattagtagagttcagtgtaggattgtagctttggatctgcgaagtcatggtgaaacaaaggtcaagaatcctgaagatctgtctgcagaaacaatggcaaaagacgttggcaatgtggttgaagccatgtatggggaccttcctcctccaattatgctgattggacatagcatgggtggtgctattgcagtccacacagcatcatccaacctggtaccaagcctcttgggtctgtgcatgattgatgttgtagaaggtacagctatggatgcacttaatagcatgcagaatttcttacggggtcgtcctaaaaccttcaagtctctggagaatgctattgaatggagtgtgaagagtggccagattcgaaatctggagtctgcccgtgtctcaatggttggccaagtcaaacagtgtgaaggaattacaagtccagaaggctcaaaatctatagtggaaggaatcatagaggaagaagaagaagatgaggaaggaagtgagtctataagcaagaggaaaaaggaagatgacatggagaccaagaaagaccatccatacacctggagaattgaactggcaaaaacagaaaaatactgggacggctggttccgaggcttatccaatctctttcttagttgtcccattcctaaattgctgctcttggctggtgttgatagattggataaagatctgaccattggccagatgcaagggaagttccagatgcaggtcctaccccagtgtggccatgcagtccatgaggatgcccctgacaaggtagctgaagctgttgccactttcctgatccggcacaggtttgcagaacccatcggtggattccagtgtgtgtttcctggctgttagtgacctgctgtccacccctcctcaacatcgagctctgttgtaaatacgtcgcaccagaggccactgtgatgccactgtctcctctccatcccgcccagccatgtgacactggctcccggtagacgggcaccccgagatgtaccaaccttttcatgtattctgccaaaagcattgttttccagggcccttgaccaacatcggcttccccagtccagggctcccctgctcctttcccttccctgtactggggtagctcctgcctgctctccctgcgttgcctagggtaaagcctccagatttgccatactgagcccctcttcctagcatcaggcgatacatctgagttcaaatgtcttcccaggctcagggacctccattccttgagattgtcttggcatggcccagccctgcctcatgggatggacaatgcatggggtggtctttatttttccctttcaaataaaacactagtcaggtaccgttttatcccagtcgtactcttccaggtttggaagacccagagaggccaagatcccatccttagccatagcgagcggtggtggtggatagcatcacaagaaacgagcctgaaaatcaggtccagccggtccaagcacatggcctcccatctgggagagcccactgtcccactcccacatgtctgggcacctgccctgggctgaggccaggctgctccaggggcctcctgcgccctcacctgccacagagcaacccaggttaaatacagcccatgcacaaagccacaggccaaagcctatggaattgtttttaatcatcaaatttaaccattttcataactggttcctggaggtgtgcagtgcccccttgcctcttcaaacctacagcttctctttgccatttgtggatttcacatcactccacacagaaacattacagcctggcatccccagtctttgccttcttccagctgcctcgacacagcactgtggcctgtccctattgcccaggcacgccatttccaagggcaggaaggggcagtgtcctgaagcccatcttttctgtgactgtcttaggtgatgtgtagccccctccacctttccactcaacaacctcccacccctgtcctgccctatgccctcgtgctctcggcccgcagggggaaggagggaggttgtcaagccttgaataaaacacaagcctccgttaaccttt

SEQ ID NO: 368931 - DNA, 1305 bp, Homo sapiens
gtgaaagtcgtcgggttcccagccgggagtctgcggagttctcatactctgttacccagcttcctttgtatgagtgctgttgcgcacttccggtggaagcgctgaagcgagtgggtggagtttacggagccggtgggcggtaggcggtgctacgggtagctgggtgctgtccaaaggcgacagggcgtcgttaggggagcgagtcgtgaccggttgggccacactcaacgtgggacgaagcttcgcctactgtttgactacgtgcgtgcagcctcccctcgatgtcggccctcgaaaagagcatgcacctcggccgccttccctctcgcccacctctacccggcagcgggggcagtcagagcggagccaagatgcgaatgggccctggaagaaagcgggacttttcccctgttccttggagtcagtattttgagtccatggaagatgtagaagtagagaatgaaactggcaaggatacttttcgagtctacaagagtggttcagagggtccagtcctgctccttctgcatggaggaggtcattctgccctttcttgggctgtgttcacggcagcgattattagtagagttcagtgtaggattgtagctttggatctgcgaagtcatggtgaaacaaaggtcaagaatcctgaagatctgtctgcagaaacaatggcaaaagacgttggcaatgtggttgaagccatgtatggggaccttcctcctccaattatgctgattggacatagcatgggtggtgctattgcagtccacacagcatcatccaacctggtaccaagcctcttgggtctgtgcatgattgatgttgtagaaggtacagctatggatgcacttaatagcatgcagaatttcttacggggtcgtcctaaaaccttcaagtctctggagaatgctattgaatggagtgtgaagagtggccagattcgaaatctggagtctgcccgtgtctcaatggttggccaagtcaaacagtgtgaaggaattacaagtccagaaggctcaaaatctatagtggaaggaatcatagaggaagaagaagaagatgaggaaggaagtgagtctataagcaagaggaaaaaggaagatgacatggagcgtgccatgtgtctgatgctgctgagcgtggcccgagcattcttgtcgatggtggtccgcacataggaggtggcaggcttccgctggccggatctccgcttattgaccaccacgacacctttgccgtcggatgacgactcaacgcccacagtcttgcggtgaatcagtccggagtagcgaaaggaattgc

SEQ ID NO: 368932 - DNA, 6477 bp, Homo sapiens
agcggattgacccggtgtcgccgcagaaccgaggtcgccgagtgatgatgttgtgaagtcgcccgcctgtccctgccacgcccgggcggttgctggcagtgggagcagcggcagcagcttcggctgctgctttcaggctgccgctgcattaggggcttcctgaggaagcgcgggcggacgacagaggatgccgaaccactccagtcatgactgtccaaagtatgataatcacatgagagtgctcgttgctacggatgtcatttgactcatcagagaaaatctgtctaaaagaaaatatccatgtgaccaaatccatttcattattgaatggcttgatggatttcctttactctgattcataccaaagctgtccttctcaaccaaagcaagaaaggatcctgcatgagtcaatcccagaatgcaatttttacatcaccaacaggtgaagaaaacctcatgaatagcaatcacagagactcggagagcatcactgatgtctgctccaatgaggatctccctgaagttgagctggtgagtctgctagaagaacaactaccacagtataggctaaaagtagacactctctttctatatgaaaatcaagactggactcagtctccacaccagcggcagcatgcatctgatgctctctctccagtccttgctgaagagactttccgttacatgattctaggcacagacagggtggagcagatgaccaaaacttacaatgacatcgacatggttacacatctcctggcagagagggatcgtgatctggaactcgctgctcgaattggacaagctctcttaaagcggaaccatgtcttatctgagcagaacgaatccctggaggagcaattgggacaagcctttgatcaagttaatcagctgcagcatgagctatgcaagaaagatgagttacttcgaatcgtctccattgcttctgaagaaagtgaaactgattccagctgttctacacctcttcggttcaatgagtcctttagcttatctcaagggttgctgcagttggaaatgctgcaagaaaagctcaaggaactggaagaagagaatatggctcttcgatccaaggcttgtcacataaagacagaaactgttacctatgaagaaaaggaacaacagcttgtcagcgactgtgttaaagaacttcgtgaaacaaatgctcagatgtccagaatgactgaagaattgtcagggaagagtgatgagctgattcgataccaagaagagctttcctctcttttgtcacagattgtagaccttcagcataaacttaaagaacatgtgattgagaaggaagaactaaaacttcacctgcaagcttccaaagatgcccaacggcaactgacaatggagctgcacgagttacaagacaggaatatggagtgtctaggaatgttacatgaatcccaagaagaaataaaggaacttcgtagtagatctggccctactgctcatctctacttctcccaatcatatggagcttttactggggaatctttggcagctgagattgaggggactatgcgtaaaaagctgagtttggatgaggaatcttctctctttaaacaaaaagcccaacagaagcgggtatttgataccgtcaggattgccaatgacacacggggccgctctatctcattcccagctctgttacccattccaggctccaaccgttcaagtgtcatcatgacagcaaaaccttttgagtctggtcttcagcaaacagaggacaaatcactcctgaaccaggggagcagctcagaggaggttgcagggagctcccagaagatgggccaaccaggaccctcaggagatagtgatttggctacagcactgcatcgccttagcttgcgtcgacaaaactatttaagtgagaagcagttctttgctgaagaatggcagcggaagatccaggttctggcagaccagaaggaaggagttagtggctgtgtcaccccgacagagagccttgcctctctctgcaccacccagtcagagatcacagacctcagcagtgccagttgccttcgaggttttatgccagaaaaattacaaattgtcaagccccttgaaggatcacaaactctgtatcactggcagcagcttgctcaaccaaacttgggaaccatccttgatccacgaccaggtgtcattactaaaggctttacccagttgcccggggatgctatttatcacatctcagatttagaagaggatgaagaggagggtattacttttcaggttcagcaacctcttgaagtggaagagaaactttcaacatccaagccagtaacagggatcttcctgccacccattacttcagcaggtggaccagttacagttgcaaccgccaacccaggaaagtgcctgtcgtgcacaaactcaacattcactttcaccacctgtagaatattacatccctctgacatcactcaggttacccccagctctgggttcccttcattatcctgtggaagtagcggtagcagttcatccaacacggctgtgaattctcctgccttgtcctatagactcagcattggtgagtccatcaccaaccgacgagattccactacaaccttcagtagcaccatgagcttggccaaacttctacaagagcgaggcatctctgccaaagtgtaccacagcccaatttcagagaaccccctccagcctctccctaaatccctggctatcccttccacaccaccaaattcaccatctcactcaccttgcccttctcctttaccctttgagcctcgagtgcatctctctgaaaattttttggcctctcgaccagctgagacattcctccaggagatgtatggcttgagaccctcccggaaccctcctgatgttggccagttgaagatgaacttagtggacaggctgaagagactggggatagccagagtggtcaagaaccctggtgcccaagagaatggaagatgccaggaggcagaaattggtcctcaaaaaccagattctgctgtttatttaaattcaggtagcagtttattaggtggactaaggaggaatcagagtcttccagtcataatgggtagctttgctgccccagtttgcacatcctcacccaaaatgggtgtcctgaaggaggactgaggttcagcagttaactgaccttttatacaagttagcacatgaaggatagatatgcactgaaacatgtggtctggtctgacttgagagaaaaggaatgttgcacaagggttgtgaatgtgaaagggggaatggaggaatggaaataaaattgggatgagccctaatggaggaagtcgggcaaattgaaagtataaatgaatgggccatgagtgttcagagggagaaaagaaaggtttaatatactccttcagttgagttttcttgtcttgaacataaaaagtgaatacaaataaattcagtaatactaaaacatacagagatactgaacttgctggcacatttacttctggtaagcataaagcagagagaacccaggttagaaggatgggaagagaaaaggagcagttttattgcttatagaaagccgttctgaggggttggtggggtaagctcagtctattactgagacaatagtgagatggcttatatgtttcccctgttaatatctggttaaattatgtatccatcaaatggtatgctcgcagcattagcaaaattaggagtttcatctttttcattgaatcacaggtggagactcctattttcctttctgttttcaggcctttgagcccctgggagcccaaataccactcaattattttgtatttatgattaataaaagttcattttttaaatttgtatttttatacaacctccaaaaaaaaaaacaactgggtagagggtgggagggatttacttttaagaggcaaaatgtgagtaaattgaaaccaagaaaacttgtttttagaatatttcgtctgaataagtacagtagccaaggaatacaaacataattgcatgtttttaaaaattccttggaggctggaaggggttaagccagaagtgcaatcaataggaattagggaatgttgtatatttatatatgtaaactttttttgtaagaaaagttggtgacaactaaaccaactttttccaaagtgcgctatgcatatttttaatgaaagatgacatgtatttgcacaaaaattctcaggcacattaaattattgtaaactgaagtaaaacccgggtgcttgctttgagattgtggttttttcttcctaatgtaaaataaaataaaacacatctgccttcttgatatttatagaattagagaataaactttttaatgggggagtcaaagctttttctttttctctaaggttctttttttttattcaaactgtatgaaatggcaaagtgaggctctggggttagatttcagcattcagcagttgacacaggctaagaaatggaaagaagtagatctgttttttctcaatgttgctgagcaaagtctgcttctcatcagatgacgtggctttgtctagacagcacgcagttcagaaagaaatgtctttatacaaaagacatgatagagaaaagatgagagaggggactaattattttgtttatgaaaatggcaagtaaattacttgatctttttggtgcttaatttgcaaatgttttgttcctttgtcctgacttaaaggcagttttctgaagaactcttgactcttgctcctatggttcccataggcacacctattcccaggccaaggagagtccttcctctccccttttgaggcatccccgccatccccccacttagagctatgtgctcaaaaagccaacatgaatgcagtggtaaaaatttgttagtttcttatactttttagaatctctcaataaaatttttctaaataaattccacaaaaacaaagggtgaagatggtctctccctttcgttccccttcactcagttgtgctgaggtcaatagagtgtagagtttcagaaaggattccagcaggtttatatgtgaatataagtgtccctgaatggggcaggcattaaatagaagaatccctgctgtttaaatttcccgcatattccaattcacttttaaaaaataccatttgaatttgtatttcataaagtgactctggggtgcttactttagtcaattcttaaaattttttatttgttccctaagaaagtaattactgtttctgttgcctggacagttacagtttccaggaaacatcaggaagtaggaaactgtagggccagagagtagtacaacgttaaattgtccgatttatgtgtattacttaaagctataaattgaactagatcttgccgtgctctgtattgagtataatttgtatacttttttataattaatgactaaatgatcactttggaggcagggtggtgggggtgtattagcagccaaataagcacatctgatcaaaaagaaccaggcttagattttttttaagtacattgatgttgatgttccaccagaaacaccttaagtgtatactgttgtgtaatgtctctagaaaggaatcctgtcttaaaactgggttttgctgttttttgaagtttctacctaaaatcatttttggtatatcctgataatctctataatactagaattgtctgcaaaatatagtaagaagaattggagcctaatagctgattcctcccaatttatctgttatgttttgtcactattcacattttagtcttttctacgataaaaattgtatgtgtactttcatgccagtataggaaacctcaatcttttttttttttcgcctttaagaaggttttcagtgattatacctcaggtatttctgagtgtcctattgtctaataggagaaatatcttcccgagctcagaattaaaagttctcctaaattatgaagatcccaaatcttatgtaaataaccttaggcatgagtccttagggagaagttaatgaccattgttaaagtgcttttttagaaaatgttgtgctgtatgttcttgatttgacataaatgaatagactttggcaagggaggaaataagttaaaaggcagcttacaagagcctattccctataaagggtataattttacacagtactcaaagcttgttatcttttctgaccattttagtacagaattagtacttggtggttactaacatcaacttgtgacatctagaactagggctcttagtgtttagtgggccacttctctgatgtcagatgcatgcagacctgtactccacatgcaacccaacagcagtgcagtgtgataactgagcggtcgcatggcagaggacatccccctcagagtgggcacaagtgccctctagggcagccaggggaatactattgttcgatacctgggatttgactttgtcaaacagctctttgtgcccctatctttgttttgtcaaatgtagatcagttaataaacatgagtagcttgaa

SEQ ID NO: 368933 - DNA, 4599 bp, Homo sapiens
cacaccacctgagtcacaccacctgagtcacaccacctgagtcacaccacctgagtcacaccacctgagtcacaccacctgagtcacaccacctgagtcacaccacctgagtcacaccacctgagtcacaccacccagtcagagatcacagacctcagcagtgccagttgccttcgaggttttatgccagaaaaattacaaattgtcaagccccttgaaggatcacaaactctgtatcactggcagcagcttgctcaaccaaacttgggaaccatccttgatccacgaccaggtgtcattactaaaggctttacccagttgcccggggatgctatttatcacatctcagatttagaagaggatgaagaggagggtattacttttcaggttcagcaacctcttgaagtggaagagaaactttcaacatccaagccagtaacagggatcttcctgccacccattacttcagcaggtggaccagttacagttgcaaccgccaacccaggaaagtgcctgtcgtgcacaaactcaacattcactttcaccacctgtagaatattacatccctctgacatcactcaggttacccccagctctgggttcccttcattatcctgtggaagtagcggtagcagttcatccaacacggctgtgaattctcctgccttgtcctatagactcagcattggtgagtccatcaccaaccgacgagattccactacaaccttcagtagcaccatgagcttggccaaacttctacaagagcgaggcatctctgccaaagtgtaccacagcccaatttcagagaaccccctccagcctctccctaaatccctggctatcccttccacaccaccaaattcaccatctcactcaccttgcccttctcctttaccctttgagcctcgagtgcatctctctgaaaattttttggcctctcgaccagctgagacattcctccaggagatgtatggcttgagaccctcccggaaccctcctgatgttggccagttgaagatgaacttagtggacaggctgaagagactggggatagccagagtggtcaagaaccctggtgcccaagagaatggaagatgccaggaggcagaaattggtcctcaaaaaccagattctgctgtttatttaaattcaggtagcagtttattaggtggactaaggaggaatcagagtcttccagtcataatgggtagctttgctgccccagtttgcacatcctcacccaaaatgggtgtcctgaaggaggactgaggttcagcagttaactgaccttttatacaagttagcacatgaaggatagatatgcactgaaacatgtggtctggtctgacttgagagaaaaggaatgttgcacaagggttgtgaatgtgaaagggggaatggaggaatggaaataaaattgggatgagccctaatggaggaagtcgggcaaattgaaagtataaatgaatgggccatgagtgttcagagggagaaaagaaaggtttaatatactccttcagttgagttttcttgtcttgaacataaaaagtgaatacaaataaattcagtaatactaaaacatacagagatactgaacttgctggcacatttacttctggtaagcataaagcagagagaacccaggttagaaggatgggaagagaaaaggagcagttttattgcttatagaaagccgttctgaggggttggtggggtaagctcagtctattactgagacaatagtgagatggcttatatgtttcccctgttaatatctggttaaattatgtatccatcaaatggtatgctcgcagcattagcaaaattaggagtttcatctttttcattgaatcacaggtggagactcctattttcctttctgttttcaggcctttgagcccctgggagcccaaataccactcaattattttgtatttatgattaataaaagttcattttttaaatttgtatttttatacaacctccaaaaaaaaaaacaactgggtagagggtgggagggatttacttttaagaggcaaaatgtgagtaaattgaaaccaagaaaacttgtttttagaatatttcgtctgaataagtacagtagccaaggaatacaaacataattgcatgtttttaaaaattccttggaggctggaaggggttaagccagaagtgcaatcaataggaattagggaatgttgtatatttatatatgtaaactttttttgtaagaaaagttggtgacaactaaaccaactttttccaaagtgcgctatgcatatttttaatgaaagatgacatgtatttgcacaaaaattctcaggcacattaaattattgtaaactgaagtaaaacccgggtgcttgctttgagattgtggttttttcttcctaatgtaaaataaaataaaacacatctgccttcttgatatttatagaattagagaataaactttttaatgggggagtcaaagctttttctttttctctaaggttctttttttttattcaaactgtatgaaatggcaaagtgaggctctggggttagatttcagcattcagcagttgacacaggctaagaaatggaaagaagtagatctgttttttctcaatgttgctgagcaaagtctgcttctcatcagatgacgtggctttgtctagacagcacgcagttcagaaagaaatgtctttatacaaaagacatgatagagaaaagatgagagaggggactaattattttgtttatgaaaatggcaagtaaattacttgatctttttggtgcttaatttgcaaatgttttgttcctttgtcctgacttaaaggcagttttctgaagaactcttgactcttgctcctatggttcccataggcacacctattcccaggccaaggagagtccttcctctccccttttgaggcatccccgccatccccccacttagagctatgtgctcaaaaagccaacatgaatgcagtggtaaaaatttgttagtttcttatactttttagaatctctcaataaaatttttctaaataaattccacaaaaacaaagggtgaagatggtctctccctttcgttccccttcactcagttgtgctgaggtcaatagagtgtagagtttcagaaaggattccagcaggtttatatgtgaatataagtgtccctgaatggggcaggcattaaatagaagaatccctgctgtttaaatttcccgcatattccaattcacttttaaaaaataccatttgaatttgtatttcataaagtgactctggggtgcttactttagtcaattcttaaaattttttatttgttccctaagaaagtaattactgtttctgttgcctggacagttacagtttccaggaaacatcaggaagtaggaaactgtagggccagagagtagtacaacgttaaattgtccgatttatgtgtattacttaaagctataaattgaactagatcttgccgtgctctgtattgagtataatttgtatacttttttataattaatgactaaatgatcactttggaggcagggtggtgggggtgtattagcagccaaataagcacatctgatcaaaaagaaccaggcttagattttttttaagtacattgatgttgatgttccaccagaaacaccttaagtgtatactgttgtgtaatgtctctagaaaggaatcctgtcttaaaactgggttttgctgttttttgaagtttctacctaaaatcatttttggtatatcctgataatctctataatactagaattgtctgcaaaatatagtaagaagaattggagcctaatagctgattcctcccaatttatctgttatgttttgtcactattcacattttagtcttttctacgataaaaattgtatgtgtactttcatgccagtataggaaacctcaatcttttttttttttcgcctttaagaaggttttcagtgattatacctcaggtatttctgagtgtcctattgtctaataggagaaatatcttcccgagctcagaattaaaagttctcctaaattatgaagatcccaaatcttatgtaaataaccttaggcatgagtccttagggagaagttaatgaccattgttaaagtgcttttttagaaaatgttgtgctgtatgttcttgatttgacataaatgaatagactttggcaagggaggaaataagttaaaaggcagcttacaagagcctattccctataaagggtataattttacacagtactcaaagcttgttatcttttctgaccattttagtacagaattagtacttggtggttactaacatcaacttgtgacatctagaactagggctcttagtgtttagtgggccacttctctgatgtcagatgcatgcagacctgtactccacatgcaacccaacagcagtgcagtgtgataactgagcggtcgcatggcagaggacatccccctcagagtgggcacaagtgccctctagggcagccaggggaatactattgttcgatacctgggatttgactttgtcaaacagctctttgtgcccctatctttgttttgtcaaatgtagatcagttaataaacatgagtagcttgaa

SEQ ID NO: 368934 - DNA, 7171 bp, Homo sapiens
  misc_feature (6486)..(6486): n is a, c, g, or t
  misc_feature (6491)..(6491): n is a, c, g, or t
  misc_feature (6498)..(6498): n is a, c, g, or t
  misc_feature (6501)..(6501): n is a, c, g, or t
  misc_feature (6506)..(6507): n is a, c, g, or t
  misc_feature (6511)..(6511): n is a, c, g, or t
  misc_feature (6517)..(6517): n is a, c, g, or t
  misc_feature (6520)..(6520): n is a, c, g, or t
  misc_feature (6523)..(6523): n is a, c, g, or t
  misc_feature (6530)..(6532): n is a, c, g, or t
agcggattgacccggtgtcgccgcagaaccgaggtcgccgagtgatgatgttgtgaagtcgcccgcctgtccctgccacgcccgggcggttgctggcagtgggagcagcggcagcagcttcggctgctgctttcaggctgccgctgcattaggggcttcctgaggaagcgcgggcggacgacagaggatgccgaaccactccagtcatgactgtccaaagtatgataatcacatgagagtgctcgttgctacggatgtcatttgactcatcagagaaaatctgtctaaaagaaaatatccatgtgaccaaatccatttcattattgaatggcttgatggatttcctttactctgattcataccaaagctgtccttctcaaccaaagcaagaaaggatcctgcatgagtcaatcccagaatgcaatttttacatcaccaacaggtgaagaaaacctcatgaatagcaatcacagagactcggagagcatcactgatgtctgctccaatgaggatctccctgaagttgagctggtgagtctgctagaagaacaactaccacagtataggctaaaagtagacactctctttctatatgaaaatcaagactggactcagtctccacaccagcggcagcatgcatctgatgctctctctccagtccttgctgaagagactttccgttacatgattctaggcacagacagggtggagcagatgaccaaaacttacaatgacatcgacatggttacacatctcctggcagagagggatcgtgatctggaactcgctgctcgaattggacaagctctcttaaagcggaaccatgtcttatctgagcagaacgaatccctggaggagcaattgggacaagcctttgatcaagttaatcagctgcagcatgagctatgcaagaaagatgagttacttcgaatcgtctccattgcttctgaagaaagtgaaactgattccagctgttctacacctcttcggttcaatgagtcctttagcttatctcaagggttgctgcagttggaaatgctgcaagaaaagctcaaggaactggaagaagagaatatggctcttcgatccaaggcttgtcacataaagacagaaactgttacctatgaagaaaaggaacaacagcttgtcagcgactgtgttaaagaacttcgtgaaacaaatgctcagatgtccagaatgactgaagaattgtcagggaagagtgatgagctgattcgataccaagaagagctttcctctcttttgtcacagattgtagaccttcagcataaacttaaagaacatgtgattgagaaggaagaactaaaacttcacctgcaagcttccaaagatgcccaacggcaactgacaatggagctgcacgagttacaagacaggaatatggagtgtctaggaatgttacatgaatcccaagaagaaataaaggaacttcgtagtagatctggccctactgctcatctctacttctcccaatcatatggagcttttactggggaatctttggcagctgagattgaggggactatgcgtaaaaagctgagtttggatgaggaatcttctctctttaaacaaaaagcccaacagaagcgggtatttgataccgtcaggattgccaatgacacacggggccgctctatctcattcccagctctgttacccattccaggctccaaccgttcaagtgtcatcatgacagcaaaaccttttgagtctggtcttcagcaaacagaggacaaatcactcctgaaccaggggagcagctcagaggaggttgcagggagctcccagaagatgggccaaccaggaccctcaggagatagtgatttggctacagcactgcatcgccttagcttgcgtcgacaaaactatttaagtgagaagcagttctttgctgaagaatggcagcggaagatccaggttctggcagaccagaaggaaggagttagtggctgtgtcaccccgacagagagccttgcctctctctgcaccacccagtcagagatcacagacctcagcagtgccagttgccttcgaggttttatgccagaaaaattacaaattgtcaagccccttgaaggatcacaaactctgtatcactggcagcagcttgctcaaccaaacttgggaaccatccttgatccacgaccaggtgtcattactaaaggctttacccagttgcccggggatgctatttatcacatctcagatttagaagaggatgaagaggagggtattacttttcaggttcagcaacctcttgaagtggaagagaaactttcaacatccaagccagtaacagggatcttcctgccacccattacttcagcaggtggaccagttacagttgcaaccgccaacccaggaaagtgcctgtcgtgcacaaactcaacattcactttcaccacctgtagaatattacatccctctgacatcactcaggttacccccagctctgggttcccttcattatcctgtggaagtagcggtagcagttcatccaacacggctgtgaattctcctgccttgtcctatagactcagcattggtgagtccatcaccaaccgacgagattccactacaaccttcagtagcaccatgagcttggccaaacttctacaagagcgaggcatctctgccaaagtgtaccacagcccaatttcagagaaccccctccagcctctccctaaatccctggctatcccttccacaccaccaaattcaccatctcactcaccttgcccttctcctttaccctttgagcctcgagtgcatctctctgaaaattttttggcctctcgaccagctgagacattcctccaggagatgtatggcttgagaccctcccggaaccctcctgatgttggccagttgaagatgaacttagtggacaggctgaagagactggggatagccagagtggtcaagaaccctggtgcccaagagaatggaagatgccaggaggcagaaattggtcctcaaaaaccagattctgctgtttatttaaattcaggtagcagtttattaggtggactaaggaggaatcagagtcttccagtcataatgggtagctttgctgccccagtttgcacatcctcacccaaaatgggtgtcctgaaggaggactgaggttcagcagttaactgaccttttatacaagttagcacatgaaggatagatatgcactgaaacatgtggtctggtctgacttgagagaaaaggaatgttgcacaagggttgtgaatgtgaaagggggaatggaggaatggaaataaaattgggatgagccctaatggaggaagtcgggcaaattgaaagtataaatgaatgggccatgagtgttcagagggagaaaagaaaggtttaatatactccttcagttgagttttcttgtcttgaacataaaaagtgaatacaaataaattcagtaatactaaaacatacagagatactgaacttgctggcacatttacttctggtaagcataaagcagagagaacccaggttagaaggatgggaagagaaaaggagcagttttattgcttatagaaagccgttctgaggggttggtggggtaagctcagtctattactgagacaatagtgagatggcttatatgtttcccctgttaatatctggttaaattatgtatccatcaaatggtatgctcgcagcattagcaaaattaggagtttcatctttttcattgaatcacaggtggagactcctattttcctttctgttttcaggcctttgagcccctgggagcccaaataccactcaattattttgtatttatgattaataaaagttcattttttaaatttgtatttttatacaacctccaaaaaaaaaaacaactgggtagagggtgggagggatttacttttaagaggcaaaatgtgagtaaattgaaaccaagaaaacttgtttttagaatatttcgtctgaataagtacagtagccaaggaatacaaacataattgcatgtttttaaaaattccttggaggctggaaggggttaagccagaagtgcaatcaataggaattagggaatgttgtatatttatatatgtaaactttttttgtaagaaaagttggtgacaactaaaccaactttttccaaagtgcgctatgcatatttttaatgaaagatgacatgtatttgcacaaaaattctcaggcacattaaattattgtaaactgaagtaaaacccgggtgcttgctttgagattgtggttttttcttcctaatgtaaaataaaataaaacacatctgccttcttgatatttatagaattagagaataaactttttaatgggggagtcaaagctttttctttttctctaaggttctttttttttattcaaactgtatgaaatggcaaagtgaggctctggggttagatttcagcattcagcagttgacacaggctaagaaatggaaagaagtagatctgttttttctcaatgttgctgagcaaagtctgcttctcatcagatgacgtggctttgtctagacagcacgcagttcagaaagaaatgtctttatacaaaagacatgatagagaaaagatgagagaggggactaattattttgtttatgaaaatggcaagtaaattacttgatctttttggtgcttaatttgcaaatgttttgttcctttgtcctgacttaaaggcagttttctgaagaactcttgactcttgctcctatggttcccataggcacacctattcccaggccaaggagagtccttcctctccccttttgaggcatccccgccatccccccacttagagctatgtgctcaaaaagccaacatgaatgcagtggtaaaaatttgttagtttcttatactttttagaatctctcaataaaatttttctaaataaattccacaaaaacaaagggtgaagatggtctctccctttcgttccccttcactcagttgtgctgaggtcaatagagtgtagagtttcagaaaggattccagcaggtttatatgtgaatataagtgtccctgaatggggcaggcattaaatagaagaatccctgctgtttaaatttcccgcatattccaattcacttttaaaaaataccatttgaatttgtatttcataaagtgactctggggtgcttactttagtcaattcttaaaattttttatttgttccctaagaaagtaattactgtttctgttgcctggacagttacagtttccaggaaacatcaggaagtaggaaactgtagggccagagagtagtacaacgttaaattgtccgatttatgtgtattacttaaagctataaattgaactagatcttgccgtgctctgtattgagtataatttgtatacttttttataattaatgactaaatgatcactttggaggcagggtggtgggggtgtattagcagccaaataagcacatctgatcaaaaagaaccaggcttagattttttttaagtacattgatgttgatgttccaccagaaacaccttaagtgtatactgttgtgtaatgtctctagaaaggaatcctgtcttaaaactgggttttgctgttttttgaagtttctacctaaaatcatttttggtatatcctgataatctctataatactagaattgtctgcaaaatatagtaagaagaattggagcctaatagctgattcctcccaatttatctgttatgttttgtcactattcacattttagtcttttctacgataaaaattgtatgtgtactttcatgccagtataggaaacctcaatcttttttttttttcgcctttaagaaggttttcagtgattatacctcaggtatttctgagtgtcctattgtctaataggagaaatatcttcccgagctcagaattaaaagttctcctaaattatgaagatcccaaatcttatgtaaataaccttaggcatgagtccttagggagaagttaatgaccattgttaaagtgcttttttagaaaatgttgtgctgtatgttcttgatttgacataaatgaatagactttggcaagggaggaaataagttaaaaggcagcttacaagagcctattccctataaagggtataattttacacagtactcaaagcttgttatcttttctgaccattttagtacagaattagtacttggtggttactaacatcaacttgtgacatctagaactagggctcttagtgtttagtgggccacttctctgatgtcagatgcatgcagacctgtactccacatgcaacccaacagcagtgcagtgtgataactgagcggtcgcatggcagaggacatccccctcagagtgggcacaagtgccctctagggcagccaggggaatactattgttcgatacctgggatttgactttgtcaaacagctctttgtgcccctatctttgttttgtcaaatgtagatcagttaataaacatgagtagcttgaaaaaaaaaanaaaanaaaaaanaanaaaannaaanaaacanaanaanaaaaaannnaaaaaaacaaaaaagagagagagaggggagaaaaaaaagaataataaataaagagagaggcagcacaaaaaaaataaacaagaccagaggccgcggacagggggcgtgtcctctatataggtgagatgtgactatatcttctatatacaccaccgagggagtcggtggtggcagagttgtatatataaaccagcgtagaagggtgggagagcacatactgtgtggcctccatggtagagcaatatcgttgcgtcgaagaggaaaaagcactctgtctctgcgcgtaatcacaagagaacaaaatacatatgaccaaccactctctctccacacaaataatctttacgacactcccttaagcacggacatctactatcccatcatattccatcaaagacgtctctatctcagaatgaaaaatcacacaaacaagcaattatacactctacgccgggtgtagtacgcgtataacggcggatgtagcgggagaccctaatccatcgccacaagaaagaagtaataagtaaccaccaaaggagagtgataaatgaatggtcgacgttgtcgcaagatgaaaatagagcagtggcggcagcagatgctgacgagcgggctggactgcaagaggaaggggagatc

SEQ ID NO: 368935 - DNA, 2713 bp, Homo sapiens
agcggattgacccggtgtcgccgcagaaccgaggtcgccgagtgatgatgttgtgaagtcgcccgcctgtccctgccacgcccgggcggttgctggcagtgggagcagcggcagcagcttcggctgctgctttcaggctgccgctgcattaggggcttcctgaggaagcgcgggcggacgacagaggatgccgaaccactccagtcatgactgtccaaagtatgataatcacatgagagtgctcgttgctacggatgtcatttgactcatcagagaaaatctgtctaaaagaaaatatccatgtgaccaaatccatttcattattgaatggcttgatggatttcctttactctgattcataccaaagctgtccttctcaaccaaagcaagaaaggatcctgcatgagtcaatcccagaatgcaatttttacatcaccaacaggtgaagaaaacctcatgaatagcaatcacagagactcggagagcatcactgatgtctgctccaatgaggatctccctgaagttgagctggtgagtctgctagaagaacaactaccacagtataggctaaaagtagacactctctttctatatgaaaatcaagactggactcagtctccacaccagcggcagcatgcatctgatgctctctctccagtccttgctgaagagactttccgttacatgattctaggcacagacagggtggagcagatgaccaaaacttacaatgacatcgacatggttacacatctcctggcagagagggatcgtgatctggaactcgctgctcgaattggacaagctctcttaaagcggaaccatgtcttatctgagcagaacgaatccctggaggagcaattgggacaagcctttgatcaagttaatcagctgcagcatgagctatgcaagaaagatgagttacttcgaatcgtctccattgcttctgaagaaagtgaaactgattccagctgttctacacctcttcggttcaatgagtcctttagcttatctcaagggttgctgcagttggaaatgctgcaagaaaagctcaaggaactggaagaagagaatatggctcttcgatccaaggcttgtcacataaagacagaaactgttacctatgaagaaaaggaacaacagcttgtcagcgactgtgttaaagaacttcgtgaaacaaatgctcagatgtccagaatgactgaagaattgtcagggaagagtgatgagctgattcgataccaagaagagctttcctctcttttgtcacagattgtagaccttcagcataaacttaaagaacatgtgattgagaaggaagaactaaaacttcacctgcaagcttccaaagatgcccaacggcaactgacaatggagctgcacgagttacaagacaggaatatggagtgtctaggaatgttacatgaatcccaagaagaaataaaggaacttcgtagtagatctggccctactgctcatctctacttctcccaatcatatggagcttttactggggaatctttggcagctgagattgaggggactatgcgtaaaaagctgagtttggatgaggaatcttctctctttaaacaaaaagcccaacagaagcgggtatttgataccgtcaggattgccaatgacacacggggccgctctatctcattcccagctctgttacccattccaggctccaaccgttcaagtgtcatcatgacagcaaaaccttttgagtctggtcttcagcaaacagaggacaaatcactcctgaaccaggggagcagctcagaggaggttgcagggagctcccagaagatgggccaaccaggaccctcaggagatagtgatttggctacagcactgcatcgccttagcttgcgtcgacaaaactatttaagtgagaagcagttctttgctgaagaatggcagcggaagatccaggttctggcagaccagaaggaaggagttagtggctgtgtcaccccgacagagagccttgcctctctctgcaccacccagtcagagatcacagacctcagcagtgccagttgccttcgaggttttatgccagaaaaattacaaattgtcaagccccttgaaggatcacaaactctgtatcactggcagcagcttgctcaaccaaacttgggaaccatccttgatccacgaccaggtgtcattactaaaggctttacccagttgcccggggatgctatttatcacatctcagatttagaagaggatgaagaggagggtattacttttcaggttcagcaacctcttgaagtggaagagaaactttcaacatccaagccagtaacagggatcttcctgccacccattacttcagcaggtggaccagttacaggtgagaagagtgtctggttgaatatggtataataaccagaagtactttgcattctgacttactagacagtcagctggctacctctgctcactggagggtacttaatcttgcatatcagataatgaaaatctatagcattagtggcattcctaattctctccactttatcttagccagcctgcgttagtagattgggtagagagctggatgaattcaagtcagtggttcacaaaccttttgggctcagaaactctttatactctaaaaaatcattgagaattccagagagcctatctgtgcaggttatatctattgacatttaatatatcataaatcaaaactgaaaaa

SEQ ID NO: 368936 - DNA, 460 bp, Homo sapiens
ttttttaatgtattttttcagttttctcatttctaatctttgtttatgccttttgctttacagttttaaagtattggattcacctatatactaaccagttgatactagtacaatctttatgtatatttatttcatttccagatttggggatttttaatacaaaaggtacttgataaatgctatattattaataaataatgatgagctttttacattattaatctagtctttcaatcttgtatttgctccctaaaaatctatttcagttgcaaccgccaacccaggaaagtgcctgtcgtgcacaaactcaacattcactttcaccacctgtagaatattacatccctctgacatcactcaggttacccccaggtaagagtgcctgggaaatctggggcctcacttctttcctcagctatattttcatgaatttctttttaaaattaccttcattttaatt

SEQ ID NO: 368937 - DNA, 645 bp, Homo sapiens
acattagctcacatggtagatgatcatagatggttatgataatacagcagaattccaattaaattcctttataacagcataacccctcactgataccccttagtaactttaatttagattagactgtaaagcaatcagtaatttaatccattctcccagccaagattctcataagtgagtggccaaacttcctgtcttaccaggggaggaggagatagtcaagatgtgactgccttttgatcatttgatactttcttaattattgtgtggtatacacttcgtttgtaatgattggactatttcttgagtgtctaatacatgaaacatttcttttttttcacatatatttttattctcctgaatgactttttgtaaaaggctggggtttttgttgttgttatctctcaattcttattaatatttaaattttttcattattgctaaagcctataaatagttgtttttaactatattagttctaggcacagacagggtggagcagatgaccaaaacttacaatgacatcgacatggttacacatctcctggcagaggtaggaatatcttttctttctccagtacaaaaaggtaaaacttgaggatcatttggaatctatcaaatttgcacatcaaatggaaaatgttg

SEQ ID NO: 368938 - DNA, 4633 bp, Homo sapiens
tgcataacaataaagaagactagtacaacttggtgatattgccttgttttgtgctgaggagccatcaattttgccttccattgcttttgcaccagcagtgcaaatgtcaacccagtcaaaaagaaaaggcctctgtcttaccattactatgaaagtagctttgacatgtagactcccacagagtctgcagaccacactttgagaaccactagagtagataaatttggctgaatcatttggatactagatcttgatttttttaatgtattttttcagttttctcatttctaatctttgtttatgccttttgctttacagttttaaagtattggattcacctatatactaaccagttgatactagtacaatctttatgtatatttatttcatttccagatttggggatttttaatacaaaaggtacttgataaatgctatattattaataaataatgatgagctttttacattattaatctagtctttcaatcttgtatttgctccctaaaaatctatttcagttgcaaccgccaacccaggaaagtgcctgtcgtgcacaaactcaacattcactttcaccacctgtagaatattacatccctctgacatcactcaggttacccccagctctgggttcccttcattatcctgtggaagtagcggtagcagttcatccaacacggctgtgaattctcctgccttgtcctatagactcagcattggtgagtccatcaccaaccgacgagattccactacaaccttcagtagcaccatgagcttggccaaacttctacaagagcgaggcatctctgccaaagtgtaccacagcccaatttcagagaaccccctccagcctctccctaaatccctggctatcccttccacaccaccaaattcaccatctcactcaccttgcccttctcctttaccctttgagcctcgagtgcatctctctgaaaattttttggcctctcgaccagctgagacattcctccaggagatgtatggcttgagaccctcccggaaccctcctgatgttggccagttgaagatgaacttagtggacaggctgaagagactggggatagccagagtggtcaagaaccctggtgcccaagagaatggaagatgccaggaggcagaaattggtcctcaaaaaccagattctgctgtttatttaaattcaggtagcagtttattaggtggactaaggaggaatcagagtcttccagtcataatgggtagctttgctgccccagtttgcacatcctcacccaaaatgggtgtcctgaaggaggactgaggttcagcagttaactgaccttttatacaagttagcacatgaaggatagatatgcactgaaacatgtggtctggtctgacttgagagaaaaggaatgttgcacaagggttgtgaatgtgaaagggggaatggaggaatggaaataaaattgggatgagccctaatggaggaagtcgggcaaattgaaagtataaatgaatgggccatgagtgttcagagggagaaaagaaaggtttaatatactccttcagttgagttttcttgtcttgaacataaaaagtgaatacaaataaattcagtaatactaaaacatacagagatactgaacttgctggcacatttacttctggtaagcataaagcagagagaacccaggttagaaggatgggaagagaaaaggagcagttttattgcttatagaaagccgttctgaggggttggtggggtaagctcagtctattactgagacaatagtgagatggcttatatgtttcccctgttaatatctggttaaattatgtatccatcaaatggtatgctcgcagcattagcaaaattaggagtttcatctttttcattgaatcacaggtggagactcctattttcctttctgttttcaggcctttgagcccctgggagcccaaataccactcaattattttgtatttatgattaataaaagttcattttttaaatttgtatttttatacaacctccaaaaaaaaaaacaactgggtagagggtgggagggatttacttttaagaggcaaaatgtgagtaaattgaaaccaagaaaacttgtttttagaatatttcgtctgaataagtacagtagccaaggaatacaaacataattgcatgtttttaaaaattccttggaggctggaaggggttaagccagaagtgcaatcaataggaattagggaatgttgtatatttatatatgtaaactttttttgtaagaaaagttggtgacaactaaaccaactttttccaaagtgcgctatgcatatttttaatgaaagatgacatgtatttgcacaaaaattctcaggcacattaaattattgtaaactgaagtaaaacccgggtgcttgctttgagattgtggttttttcttcctaatgtaaaataaaataaaacacatctgccttcttgatatttatagaattagagaataaactttttaatgggggagtcaaagctttttctttttctctaaggttctttttttttattcaaactgtatgaaatggcaaagtgaggctctggggttagatttcagcattcagcagttgacacaggctaagaaatggaaagaagtagatctgttttttctcaatgttgctgagcaaagtctgcttctcatcagatgacgtggctttgtctagacagcacgcagttcagaaagaaatgtctttatacaaaagacatgatagagaaaagatgagagaggggactaattattttgtttatgaaaatggcaagtaaattacttgatctttttggtgcttaatttgcaaatgttttgttcctttgtcctgacttaaaggcagttttctgaagaactcttgactcttgctcctatggttcccataggcacacctattcccaggccaaggagagtccttcctctccccttttgaggcatccccgccatccccccacttagagctatgtgctcaaaaagccaacatgaatgcagtggtaaaaatttgttagtttcttatactttttagaatctctcaataaaatttttctaaataaattccacaaaaacaaagggtgaagatggtctctccctttcgttccccttcactcagttgtgctgaggtcaatagagtgtagagtttcagaaaggattccagcaggtttatatgtgaatataagtgtccctgaatggggcaggcattaaatagaagaatccctgctgtttaaatttcccgcatattccaattcacttttaaaaaataccatttgaatttgtatttcataaagtgactctggggtgcttactttagtcaattcttaaaattttttatttgttccctaagaaagtaattactgtttctgttgcctggacagttacagtttccaggaaacatcaggaagtaggaaactgtagggccagagagtagtacaacgttaaattgtccgatttatgtgtattacttaaagctataaattgaactagatcttgccgtgctctgtattgagtataatttgtatacttttttataattaatgactaaatgatcactttggaggcagggtggtgggggtgtattagcagccaaataagcacatctgatcaaaaagaaccaggcttagattttttttaagtacattgatgttgatgttccaccagaaacaccttaagtgtatactgttgtgtaatgtctctagaaaggaatcctgtcttaaaactgggttttgctgttttttgaagtttctacctaaaatcatttttggtatatcctgataatctctataatactagaattgtctgcaaaatatagtaagaagaattggagcctaatagctgattcctcccaatttatctgttatgttttgtcactattcacattttagtcttttctacgataaaaattgtatgtgtactttcatgccagtataggaaacctcaatcttttttttttttcgcctttaagaaggttttcagtgattatacctcaggtatttctgagtgtcctattgtctaataggagaaatatcttcccgagctcagaattaaaagttctcctaaattatgaagatcccaaatcttatgtaaataaccttaggcatgagtccttagggagaagttaatgaccattgttaaagtgcttttttagaaaatgttgtgctgtatgttcttgatttgacataaatgaatagactttggcaagggaggaaataagttaaaaggcagcttacaagagcctattccctataaagggtataattttacacagtactcaaagcttgttatcttttctgaccattttagtacagaattagtacttggtggttactaacatcaacttgtgacatctagaactagggctcttagtgtttagtgggccacttctctgatgtcagatgcatgcagacctgtactccacatgcaacccaacagcagtgcagtgtgataactgagcggtcgcatggcagaggacatccccctcagagtgggcacaagtgccctctagggcagccaggggaatactattgttcgatacctgggatttgactttgtcaaacagctctttgtgcccctatctttgttttgtcaaatgtagatcagttaataaacatgagtagcttgaa

SEQ ID NO: 368939 - DNA, 7119 bp, Homo sapiens
  misc_feature (6434)..(6434): n is a, c, g, or t
  misc_feature (6439)..(6439): n is a, c, g, or t
  misc_feature (6446)..(6446): n is a, c, g, or t
  misc_feature (6449)..(6449): n is a, c, g, or t
  misc_feature (6454)..(6455): n is a, c, g, or t
  misc_feature (6459)..(6459): n is a, c, g, or t
  misc_feature (6465)..(6465): n is a, c, g, or t
  misc_feature (6468)..(6468): n is a, c, g, or t
  misc_feature (6471)..(6471): n is a, c, g, or t
  misc_feature (6478)..(6480): n is a, c, g, or t
agcggattgacccggtgtcgccgcagaaccgaggtcgccgagtgatgatgttgtgaagtcgcccgcctgtccctgccacgcccgggcggttgctggcagtgggagcagcggcagcagcttcggctgctgctttcaggctgccgctgcattaggggcttcctgaggaagcgcgggcggacgacagaggatgccgaaccactccagtcatgactgtccaaagtatgataatcacatgagagtgctcgttgctacggatgtcatttgactcatcagagaaaatctgtctaaaagaaaatatccatgtgaccaaatccatttcattattgaatggcttgatggatttcctttactctgattcataccaaagctgtccttctcaaccaaagcaagaaaggatcctgcatgagtcaatcccagaatgcaatttttacatcaccaacaggtgaagaaaacctcatgaatagcaatcacagagactcggagagcatcactgatgtctgctccaatgaggatctccctgaagttgagctggtgagtctgctagaagaacaactaccacagtataggctaaaagtagacactctctttctatatgaaaatcaagactggactcagtctccacaccagcggcagcatgcatctgatgctctctctccagtccttgctgaagagactttccgttacatgattctaggcacagacagggtggagcagatgaccaaaacttacaatgacatcgacatggttacacatctcctggcagagagggatcgtgatctggaactcgctgctcgaattggacaagctctcttaaagcggaaccatgtcttatctgagcagaacgaatccctggaggagcaattgggacaagcctttgatcaagttaatcagctgcagcatgagctatgcaagaaagatgagttacttcgaatcgtctccattgcttctgaagaaagtgaaactgattccagctgttctacacctcttcggttcaatgagtcctttagcttatctcaagggttgctgcagttggaaatgctgcaagaaaagctcaaggaactggaagaagagaatatggctcttcgatccaaggcttgtcacataaagacagaaactgttacctatgaagaaaaggaacaacagcttgtcagcgactgtgttaaagaacttcgtgaaacaaatgctcagatgtccagaatgactgaagaattgtcagggaagagtgatgagctgattcgataccaagaagagctttcctctcttttgtcacagattgtagaccttcagcataaacttaaagaacatgtgattgagaaggaagaactaaaacttcacctgcaagcttccaaagatgcccaacggcaactgacaatggagctgcacgagttacaagacaggaatatggagtgtctaggaatgttacatgaatcccaagaagaaataaaggaacttcgtagtagatctggccctactgctcatctctacttctcccaatcatatggagcttttactggggaatctttggcagctgagattgaggggactatgcgtaaaaagctgagtttggatgaggaatcttctctctttaaacaaaaagcccaacagaagcgggtatttgataccgtcaggattgccaatgacacacggggccgctctatctcattcccagctctgttacccattccaggctccaaccgttcaagtgtcatcatgacagcaaaaccttttgagtctggtcttcagcaaacagaggacaaatcactcctgaaccaggggagcagctcagaggaggttgcagggagctcccagaagatgggccaaccaggaccctcaggagatagtgatttggctacagcactgcatcgccttagcttgcgtcgacaaaactatttaagtgagaagcagttctttgctgaagaatggcagcggaagatccaggttctggcagaccagaaggaaggagttagtggctgtgtcaccccgacagagagccttgcctctctctgcaccacccagtcagagatcacagacctcagcagtgccagttgccttcgaggttttatgccagaaaaattacaaattgtcaagccccttgaaggatcacaaactctgtatcactggcagcagcttgctcaaccaaacttgggaaccatccttgatccacgaccaggtgtcattactaaaggctttacccagttgcccggggatgctatttatcacatctcagatttagaagaggatgaagaggagggtattacttttcaggttcagcaacctcttgaagtggaagagaaactttcaacatccaagccagtaacagggatcttcctgccacccattacttcagcaggtggaccagttacagttgcaaccgccaacccaggaaagtgcctgtcgtgcacaaactcaacattcactttcaccacctgtagaatattacatccctctgacatcactcaggttacccccagctctgggttcccttcattatcctgtggaagtagcggtagcagttcatccaacacggctgtgaattctcctgccttgtcctatagactcagcattggtgagtccatcaccaaccgacgagattccactacaaccttcagtagcaccatgagcttggccaaacttctacaagagcgaggcatctctgccaaagtgtaccacagcccaatttcagagaaccccctccagcctctccctaaatccctggctatcccttccacaccaccaaattcaccatctcactcaccttgcccttctcctttaccctttgagcctcgagtgcatctctctgaaaattttttggcctctcgaccagctgagacattcctccaggagatgtatggcttgagaccctcccggaaccctcctgatgttggccagttgaagatgaacttagtggacaggctgaagagactggggatagccagagtggtcaagaaccctggtgcccaagagaatggaagatgccaggaggcagaaattggtcctcaaaaaccagattctgctgtttatttaaattcaggtagcagtttattaggtggactaaggaggaatcagagtcttccagtcataatgggtagctttgctgccccagtttgcacatcctcacccaaaatgggtgtcctgaaggaggactgaggttcagcagttaactgaccttttatacaagttagcacatgaaggatagatatgcactgaaacatgtggtctggtctgacttgagagaaaaggaatgttgcacaagggttgtgaatgtgaaagggggaatggaggaatggaaataaaattgggatgagccctaatggaggaagtcgggcaaattgaaagtataaatgaatgggccatgagtgttcagagggagaaaagaaaggtttaatatactccttcagttgagttttcttgtcttgaacataaaaagtgaatacaaataaattcagtaatactaaaacatacagagatactgaacttgctggcacatttacttctggtaagcataaagcagagagaacccaggttagaaggatgggaagagaaaaggagcagttttattgcttatagaaagccgttctgaggggttggtggggtaagctcagtctattactgagacaatagtgagatggcttatatgtttcccctgttaatatctggttaaattatgtatccatcaaatggtatgctcgcagcattagcaaaattaggagtttcatctttttcattgaatcacaggtggagactcctattttcctttctgttttcaggcctttgagcccctgggagcccaaataccactcaattattttgtatttatgattaataaaagttcattttttaaatttgtatttttatacaacctccaaaaaaaaaaacaactgggtagagggtgggagggatttacttttaagaggcaaaatgtgagtaaattgaaaccaagaaaacttgtttttagaatatttcgtctgaataagtacagtagccaaggaatacaaacataattgcatgtttttaaaaattccttggaggctggaaggggttaagccagaagtgcaatcaataggaattagggaatgttgtatatttatatatgtaaactttttttgtaagaaaagttggtgacaactaaaccaactttttccaaagtgcgctatgcatatttttaatgaaagatgacatgtatttgcacaaaaattctcaggcacattaaattattgtaaactgaagtaaaacccgggtgcttgctttgagattgtggttttttcttcctaatgtaaaataaaataaaacacatctgccttcttgatatttatagaattagagaataaactttttaatgggggagtcaaagctttttctttttctctaaggttctttttttttattcaaactgtatgaaatggcaaagtgaggctctggggttagatttcagcattcagcagttgacacaggctaagaaatggaaagaagtagatctgttttttctcaatgttgctgagcaaagtctgcttctcatcagatgacgtggctttgtctagacagcacgcagttcagaaagaaatgtctttatacaaaagacatgatagagaaaagatgagagaggggactaattattttgtttatgaaaatggcaagtaaattacttgatctttttggtgcttaatttgcaaatgttttgttcctttgtcctgacttaaaggcagttttctgaagaactcttgactcttgctcctatggttcccataggcacacctattcccaggccaaggagagtccttcctctccccttttgaggcatccccgccatccccccacttagagctatgtgctcaaaaagccaacatgaatgcagtggtaaaaatttgttagtttcttatactttttagaatctctcaataaaatttttctaaataaattccacaaaaacaaagggtgaagatggtctctccctttcgttccccttcactcagttgtgctgaggtcaatagagtgtagagtttcagaaaggattccagcaggtttatatgtgaatataagtgtccctgaatggggcaggcattaaatagaagaatccctgctgtttaaatttcccgcatattccaattcacttttaaaaaataccatttgaatttgtatttcataaagtgactctggggtgcttactttagtcaattcttaaaattttttatttgttccctaagaaagtaattactgtttctgttgcctggacagttacagtttccaggaaacatcaggaagtaggaaactgtagggccagagagtagtacaacgttaaattgtccgatttatgtgtattacttaaagctataaattgaactagatcttgccgtgctctgtattgagtataatttgtatacttttttataattaatgactaaatgatcactttggaggcagggtggtgggggtgtattagcagccaaataagcacatctgatcaaaaagaaccaggcttagattttttttaagtacattgatgttgatgttccaccagaaacaccttaagtgtatactgttgtgtaatgtctctagaaaggaatcctgtcttaaaactgggttttgctgttttttgaagtttctacctaaaatcatttttggtatatcctgataatctctataatactagaattgtctgcaaaatatagtaagaagaattggagcctaatagctgattcctcccaatttatctgttatgttttgtcactattcacattttagtcttttctacgataaaaattgtatgtgtactttcatgccagtataggaaacctcaatcttttttttttttcgcctttaagaaggttttcagtgattatacctcaggtatttctgagtgtcctattgtctaataggagaaatatcttcccgagctcagaattaaaagttctcctaaattatgaagatcccaaatcttatgtaaataaccttaggcatgagtccttagggagaagttaatgaccattgttaaagtgcttttttagaaaatgttgtgctgtatgttcttgatttgacataaatgaatagactttggcaagggaggaaataagttaaaaggcagcttacaagagcctattccctataaagggtataattttacacagtactcaaagcttgttatcttttctgaccattttagtacagaattagtacttggtggttactaacatcaacttgtgacatctagaactagggctcttagtgtttagtgggccacttctctgatgtcagatgcatgcagacctgtactccacatgcaacccaacagcagtgcagtgtgataactgagcggtcgcatggcagaggacatccccctcagagtgggcacaagtgccctctagggcagccaggggaatactattgttcgatacctgggatttgactttgtcaaacagctctttgtgcccaaaaaaaanaaaanaaaaaanaanaaaannaaanaaacanaanaanaaaaaannnaaaaaaacaaaaaagagagagagaggggagaaaaaaaagaataataaataaagagagaggcagcacaaaaaaaataaacaagaccagaggccgcggacagggggcgtgtcctctatataggtgagatgtgactatatcttctatatacaccaccgagggagtcggtggtggcagagttgtatatataaaccagcgtagaagggtgggagagcacatactgtgtggcctccatggtagagcaatatcgttgcgtcgaagaggaaaaagcactctgtctctgcgcgtaatcacaagagaacaaaatacatatgaccaaccactctctctccacacaaataatctttacgacactcccttaagcacggacatctactatcccatcatattccatcaaagacgtctctatctcagaatgaaaaatcacacaaacaagcaattatacactctacgccgggtgtagtacgcgtataacggcggatgtagcgggagaccctaatccatcgccacaagaaagaagtaataagtaaccaccaaaggagagtgataaatgaatggtcgacgttgtcgcaagatgaaaatagagcagtggcggcagcagatgctgacgagcgggctggactgcaagaggaaggggagatc

SEQ ID NO: 368940 - DNA, 3604 bp, Homo sapiens
tcggtacccatattggttggcgaggagcaagcgggggatctttttccagagttggtgagggcaccgggctgcaggaaggcagcaacaactcatctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattctggaggttctctcccgccagcttcgggactggaagagccagctggctgtccctcacccagaaacccaggacagtagcacacagactgacacatctcacagtgggataactaataaacttcagcatcttaaggagagccatgagatgggacaggccctacagcaggccagaaatgtcatgcaatcatgggtgcttatctctaaagagctgatatccttgcttcacctatccctgttgcatttagaagaagataagactactgtgagtcaggagtctcggcgtgcagaaacattggtctgttgctgttttgatttgctgaagaaattgagggcaaagctccagagcctcaaagcagaaagggaggaggcaaggcacagagaggaaatggctctcagaggcaaggatgcggcagagatagtgttggaggctttctgtgcacacgccagccagcgcatcagccagctggaacaggacctagcatccatgcgggaattcagaggccttctgaaggatgcccagacccaactggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggaggtttctagggtgctggaacaagtctctgcccagttagaggagtgcaaaggccaaacagaacaactggagttggaaaacagtcgtctagcaacagatctccgggctcagttgcagattctggccaacatggacagccagctaaaagagctacagagtcagcatacccattgtgcccaggacctggctatgaaggatgagttactctgccagcttacccagagcaatgaggagcaggctgctcaatggcaaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagactgaacaagagacccttctgctgagtacagcctgtcctcccacccaggaacaccctctgcctaatgacaggaccttcctgggaagcatcttgacagcagtggcagatgaagagccagaatcaactcctgtgcccttgcttggaagtgacaagagtgctttcacccgagtagcatcaatggtttcccttcagcccgcagagaccccaggcatggaggagagcctggcagaaatgagtattatgactactgagcttcagagtctttgttccctgctacaagagtctaaagaagaagccatcaggactctgcagcgaaaaatttgtgagctgcaagctaggctgcaggcccaggaagaacagcatcaggaagtccagaaggcaaaagaagcagacatagagaagctgaaccaggccttgtgcttgcgctacaagaatgaaaaggagctccaggaagtgatacagcagcagaatgagaagatcctagaacagatagacaagagtggcgagctcataagccttagagaggaggtgacccaccttacccgctcacttcggcgtgcggagacagagaccaaagtgctccaggaggccctggcaggccagctggactccaactgccagcctatggccaccaattggatccaggagaaagtgtggctctctcaggaggtggacaaactgagagtgatgttcctggagatgaaaaatgagaaggaaaaactcatgatcaagttccagagccatagaaatatcctagaggagaaccttcggcgctctgacaaggagttagaaaaactagatgacattgttcagcatatttataagaccctgctctctattccagaggtggtgaggggatgcaaagaactacagggattgctggaatttctgagctaagaaactgaaagccagaatctgcttcacctctttttacctgcaatacccccttaccccaataccaagaccaactggcatagagccaactgagataaatgctatttaaataaagtgtatttaatgaa

SEQ ID NO: 368941 - DNA, 4085 bp, Homo sapiens
  misc_feature (2538)..(2538): n is a, c, g, or t
caggagggatggactcctggactctccagctacctgcgtggtcctccccggtgtgaggacagaagaccggtcctggaccgggcccgcatccagccctaccgccggtgtctgaggtgagggctccgtcagcggaaaacgctcgacaacggaggggcaggcagggccgggggcgtggtcaacgcgggccccgccccccgggctctacccccgagcgtacgcgcgcgcctgaagcagccaaccaggaagcgcagagcaggttcaaacacagacggcgggtgaacatggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcaggaaggcagcaacaactcatctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattctggaggttctctcccgccagcttcgggactggaagagccagctggctgtccctcacccagaaacccaggacagtagcacacagactgacacatctcacagtgggataactaataaacttcagcatcttaaggagagccatgagatgggacaggccctacagcaggccagaaatgtcatgcaatcatgggtgcttatctctaaagagctgatatccttgcttcacctatccctgttgcatttagaagaagataagactactgtgagtcaggagtctcggcgtgcagaaacattggtctgttgctgttttgatttgctgaagaaattgagggcaaagctccagagcctcaaagcagaaagggaggaggcaaggcacagagaggaaatggctctcagaggcaaggatgcggcagagatagtgttggaggctttctgtgcacacgccagccagcgcatcagccagctggaacaggacctagcatccatgcgggaattcagaggccttctgaaggatgcccagacccaactggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggaggtttctagggtgctggaacaagtctctgcccagttagaggagtgcaaaggccaaacagaacaactggagttggaaaacagtcgtctagcaacagatctccgggctcagttgcagattctggcccggagatctgcaacngatctccgggctcagttgcagattctggccaacatggacagccagctaaaagagctacagagtcagcatacccattgtgcccaggacctggctatgaaggatgagttactctgccagcttacccagagcaatgaggagcaggctgctcaatggcaaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagactgaacaagagacccttctgctgagtacagcctgtcctcccacccaggaacaccctctgcctaatgacaggaccttcctgggaagcatcttgacagcagtggcagatgaagagccagaatcaactcctgtgcccttgcttggaagtgacaagagtgctttcacccgagtagcatcaatggtttcccttcagcccgcagagaccccaggcatggaggagagcctggcagaaatgagtattatgactactgagcttcagagtctttgttccctgctacaagagtctaaagaagaagccatcaggactctgcagcgaaaaatttgtgagctgcaagctaggctgcaggcccaggaagaacagcatcaggaagtccagaaggcaaaagaagcagacatagagaagctgaaccaggccttgtgcttgcgctacaagaatgaaaaggagctccaggaagtgatacagcagcagaatgagaagatcctagaacagatagacaagagtggcgagctcataagccttagagaggaggtgacccaccttacccgctcacttcggcgtgcggagacagagaccaaagtgctccaggaggccctggcaggccagctggactccaactgccagcctatggccaccaattggatccaggagaaagtgtggctctctcaggaggtggacaaactgagagtgatgttcctggagatgaaaaatgagaaggaaaaactcatgatcaagttccagagccatagaaatatcctagaggagaaccttcggcgctctgacaaggagttagaaaaactagatgacattgttcagcatatttataagaccctgctctctattccagaggtggtgaggggatgcaaagaactacagggattgctggaatttctgagctaagaaactgaaagccagaatctgcttcacctctttttacctgcaatacccccttaccccaataccaagaccaactggcatagagccaactgagataaatgctatttaaataaagtgtatttaatgaa

SEQ ID NO: 368942 - DNA, 4424 bp, Homo sapiens
  misc_feature (4044)..(4044): n is a, c, g, or t
caggagggatggactcctggactctccagctacctgcgtggtcctccccggtgtgaggacagaagaccggtcctggaccgggcccgcatccagccctaccgccggtgtctgaggtgagggctccgtcagcggaaaacgctcgacaacggaggggcaggcagggccgggggcgtggtcaacgcgggccccgccccccgggctctacccccgagcgtacgcgcgcgcctgaagcagccaaccaggaagcgcagagcaggttcaaacacagacggcgggtgaacatggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcaggaaggcagcaacaactcatctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattctggaggttctctcccgccagcttcgggactggaagagccagctggctgtccctcacccagaaacccaggacagtagcacacagactgacacatctcacagtgggataactaataaacttcagcatcttaaggagagccatgagatgggacaggccctacagcaggccagaaatgtcatgcaatcatgggtgcttatctctaaagagctgatatccttgcttcacctatccctgttgcatttagaagaagataagactactgtgagtcaggagtctcggcgtgcagaaacattggtctgttgctgttttgatttgctgaagaaattgagggcaaagctccagagcctcaaagcagaaagggaggaggcaaggcacagagaggaaatggctctcagaggcaaggatgcggcagagatagtgttggaggctttctgtgcacacgccagccagcgcatcagccagctggaacaggacctagcatccatgcgggaattcagaggccttctgaaggatgcccagacccaactggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggaggtttctagggtgctggaacaagtctctgcccagttagaggagtgcaaaggccaaacagaacaactggagttggaaaacagtcgtctagcaacagatctccgggctcagttgcagattctggccaacatggacagccagctaaaagagctacagagtcagcatacccattgtgcccaggacctggctatgaaggatgagttactctgccagcttacccagagcaatgaggagcaggctgctcaatggcaaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagactgaacaagagacccttctgctgagtacagcctgtcctcccacccaggaacaccctctgcctaatgacaggaccttcctgggaagcatcttgacagcagtggcagatgaagagccagaatcaactcctgtgcccttgcttggaagtgacaagagtgctttcacccgagtagcatcaatggtttcccttcagcccgcagagaccccaggcatggaggagagcctggcagaaatgagtattatgactactgagcttcagagtctttgttccctgctacaagagtctaaagaagaagccatcaggactctgcagcgaaaaatttgtgagctgcaagctaggctgcaggcccaggaagaacagcatcaggaagtccagaaggcaaaagaagcagacatagagaagctgaaccaggccttgtgcttgcgctacaagaatgaaaaggagctccaggaagtgatacagcagcagaatgagaagatcctagaacagatagacaagagtggcgagctcataagccttagagaggaggtgacccaccttacccgctcacttcggcgtgcggagacagagaccaaagtgctccaggaggccctggcaggccagctggactccaactgccagcctatggccaccaattggatccaggagaaagtgtggctctctcaggaggtggacaaactgagagtgatgttcctggagatgaaaaatgagaaggaaaaactcatgatcaagttccagagccatagaaatatcctagaggagaaccttcggcgctctgacaaggagttagaaaaactagatgacattgttcagcatatttataagaccctgctctctattccagaggtggtgaggggatgcaaagaactacagggattgctggaatttctgagctaagaaactgaaagccagaatctgcttcacctctttttacctgcaatacccccttaccccaataccaagaccaactggcatagagccaactgagataaatgctatttaaataaagtgtatttaatgaaaaanaaaaaaacaaaaaaaaaacaaaaaaaaaaaaaaaaagagaagacaaccacaacaagaaaaaaacacacaaaggagacgaaaaaagaagcgggggggcggccccgaaaaaatactccacgccgagggggggggcccacaaaacaaagtaggagcaccaccctgatgtgtatgatagaaacagcggggggccgcccaataagagaaggggagtctataattatgaaaaaaaacaagggcgggcgcggcagggttaaaaacaaggaagcgagacggggtaggaaacaagaaggggcgcgcagcagtagtgctcggcgagaaaagcaaacccacacactagtaggggggggagcaaacaagctatgggaagacagccccccgag

SEQ ID NO: 368943 - DNA, 4279 bp, Homo sapiens
caggagggatggactcctggactctccagctacctgcgtggtcctccccggtgtgaggacagaagaccggtcctggaccgggcccgcatccagccctaccgccggtgtctgaggtgagggctccgtcagcggaaaacgctcgacaacggaggggcaggcagggccgggggcgtggtcaacgcgggccccgccccccgggctctacccccgagcgtacgcgcgcgcctgaagcagccaaccaggaagcgcagagcaggttcaaacacagacggcgggtgaacatggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcaggaaggcagcaacaactcatctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattctggaggttctctcccgccagcttcgggactggaagagccagctggctgtccctcacccagaaacccaggacagtagcacacagactgacacatctcacagtgggataactaataaacttcagcatcttaaggagagccatgagatgggacaggccctacagcaggccagaaatgtcatgcaatcatgggtgcttatctctaaagagctgatatccttgcttcacctatccctgttgcatttagaagaagataagactactgtgagtcaggagtctcggcgtgcagaaacattggtctgttgctgttttgatttgctgaagaaattgagggcaaagctccagagcctcaaagcagaaagggaggaggcaaggcacagagaggaaatggctctcagaggcaaggatgcggcagagatagtgttggaggctttctgtgcacacgccagccagcgcatcagccagctggaacaggacctagcatccatgcgggaattcagaggccttctgaaggatgcccagacccaactggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggaggtttctagggtgctggaacaagtctctgcccagttagaggagtgcaaaggccaaacagaacaactggagttggaaaacagtcgtctagcaacagatctccgggctcagttgcagattctggccaacatggacagccagctaaaagagctacagagtcagcatacccattgtgcccaggacctggctatgaaggatgagttactctgccagcttacccagagcaatgaggagcaggctgctcaatggcaaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagactgaacaagagacccttctgctgagtacagcctgtcctcccacccaggaacaccctctgcctaatgacaggaccttcctgggaagcatcttgacagcagtggcagatgaagagccagaatcaactcctgtgcccttgcttggaagtgacaagagtgctttcacccgagtagcatcaatggtttcccttcagcccgcagagaccccaggcatggaggagagcctggcagaaatgagtattatgactactgagcttcagagtctttgttccctgctacaagagtctaaagaagaagccatcaggactctgcagcgaaaaatttgtgagctgcaagctaggctgcaggcccaggaagaacagcatcaggaagtccagaaggcaaaagaagcagacatagagaagctgaaccaggccttgtgcttgcgctacaagaatgaaaaggagctccaggaagtgatacagcagcagaatgagaagatcctagaacagatagacaagagtggcgagctcataagccttagagaggaggtgacccaccttacccgctcacttcggcgtgcggagacagagaccaaagtgctccaggaggccctggcaggccagctggactccaactgccagcctatggccaccaattggatccaggagaaagtgtggctctctcaggaggtggacaaactgagagtgatgttcctggagatgaaaaatgagaaggaaaaactcatgatcaagttccagagccatagaaatatcctagaggagaaccttcggcgctctgacaaggagttagaaaaactagatgacattgttcagcatatttataaggtataggcaggagggaggtgatatcactaatgaacctggtacaaggcctggccccaggaggtactaatgagcacagatctggttcccagcctgtgctgagagctgggcctgaatcactattgcaggcttctctgtggtgtctgttttctcccctctaattcagcggctgcctcctggggctgggagccctgggccttaagtctgtggtcctgagctgcgttttctgcctctcttcccagaccctgctctctattccagaggtggtgaggggatgcaaagaactacagggattgctggaatttctgagctaagaaactgaaagccagaatctgcttcacctctttttacctgcaatacccccttaccccaataccaagaccaactggcatagagccaactgagataaatgctatttaaataaagtgtatttaatgaa

SEQ ID NO: 368944 - DNA, 4359 bp, Homo sapiens
caggagggatggactcctggactctccagctacctgcgtggtcctccccggtgtgaggacagaagaccggtcctggaccgggcccgcatccagccctaccgccggtgtctgaggtgagggctccgtcagcggaaaacgctcgacaacggaggggcaggcagggccgggggcgtggtcaacgcgggccccgccccccgggctctacccccgagcgtacgcgcgcgcctgaagcagccaaccaggaagcgcagagcaggttcaaacacagacggcgggtgaacatggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcaggaaggcagcaacaactcatctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattctggaggttctctcccgccagcttcgggactggaagagccagctggctgtccctcacccagaaacccaggacagtagcacacagactgacacatctcacagtgggataactaataaacttcagcatcttaaggagagccatgagatgggacaggccctacagcaggccagaaatgtcatgcaatcatgggtgcttatctctaaagagctgatatccttgcttcacctatccctgttgcatttagaagaagataagactactgtgagtcaggagtctcggcgtgcagaaacattggtctgttgctgttttgatttgctgaagaaattgagggcaaagctccagagcctcaaagcagaaagggaggaggcaaggcacagagaggaaatggctctcagaggcaaggatgcggcagagatagtgttggaggctttctgtgcacacgccagccagcgcatcagccagctggaacaggacctagcatccatgcgggaattcagaggccttctgaaggatgcccagacccaactggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggaggtttctagggtgctggaacaagtctctgcccagttagaggagtgcaaaggccaaacagaacaactggagttggaaaacagtcgtctagcaacagatctccgggctcagttgcagattctggccaacatggacagccagctaaaagagctacagagtcagcatacccattgtgcccaggacctggctatgaaggatgagttactctgccagcttacccagagcaatgaggagcaggctgctcaatggcaaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagactgaacaagagacccttctgctgagtacagcctgtcctcccacccaggaacaccctctgcctaatgacaggaccttcctgggaagcatcttgacagcagtggcagatgaagagccagaatcaactcctgtgcccttgcttggaagtgacaagagtgctttcacccgagtagcatcaatggtttcccttcagcccgcagagaccccaggcatggaggagagcctggcagaaatgagtattatgactactgagcttcagagtctttgttccctgctacaagagtctaaagaagaagccatcaggactctgcagcgaaaaatttgtgagctgcaagctaggctgcaggcccaggaagaacagcatcaggaagtccagaaggcaaaagaagcagacatagagaagctgaaccaggccttgtgcttgcgctacaagaatgaaaaggagctccaggaagtgatacagcagcagaatgagaagatcctagaacagatagacaagagtggcgagctcataagccttagagaggaggtgacccaccttacccgctcacttcggcgtgcggagacagagaccaaagtgctccaggaggccctggcaggccagctggactccaactgccagcctatggccaccaattggatccaggagaaagtgtggctctctcaggaggtgactcagagttaacagaggagctggacagcaggtggggaccccaggctgtacccctgttgatctggacatatttctaggtggacaaactgagagtgatgttcctggagatgaaaaatgagaaggaaaaactcatgatcaagttccagagccatagaaatatcctagaggagaaccttcggcgctctgacaaggagttagaaaaactagatgacattgttcagcatatttataaggtataggcaggagggaggtgatatcactaatgaacctggtacaaggcctggccccaggaggtactaatgagcacagatctggttcccagcctgtgctgagagctgggcctgaatcactattgcaggcttctctgtggtgtctgttttctcccctctaattcagcggctgcctcctggggctgggagccctgggccttaagtctgtggtcctgagctgcgttttctgcctctcttcccagaccctgctctctattccagaggtggtgaggggatgcaaagaactacagggattgctggaatttctgagctaagaaactgaaagccagaatctgcttcacctctttttacctgcaatacccccttaccccaataccaagaccaactggcatagagccaactgagataaatgctatttaaataaagtgtatttaatgaa

SEQ ID NO: 368945 - DNA, 4486 bp, Homo sapiens
caggagggatggactcctggactctccagctacctgcgtggtcctccccggtgtgaggacagaagaccggtcctggaccgggcccgcatccagccctaccgccggtgtctgaggtgagggctccgtcagcggaaaacgctcgacaacggaggggcaggcagggccgggggcgtggtcaacgcgggccccgccccccgggctctacccccgagcgtacgcgcgcgcctgaagcagccaaccaggaagcgcagagcaggttcaaacacagacggcgggtgaacatggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcaggaaggcagcaacaactcatctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattctggaggttctctcccgccagcttcgggactggaagagccagctggctgtccctcacccagaaacccaggacagtagcacacagactgacacatctcacagtgggataactaataaacttcagcatcttaaggagagccatgagatgggacaggccctacagcaggccagaaatgtcatgcaatcatgggtgcttatctctaaagagctgatatccttgcttcacctatccctgttgcatttagaagaagataagactactgtgagtcaggagtctcggcgtgcagaaacattggtctgttgctgttttgatttgctgaagaaattgagggcaaagctccagagcctcaaagcagaaagggaggaggcaaggcacagagaggaaatggctctcagaggcaaggatgcggcagagatagtgttggaggctttctgtgcacacgccagccagcgcatcagccagctggaacaggacctagcatccatgcgggaattcagaggccttctgaaggatgcccagacccaactggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggaggtttctagggtgctggaacaagtctctgcccagttagaggagtgcaaaggccaaacagaacaactggagttggaaaacagtcgtctagcaacagatctccgggctcagttgcagattctggccaacatggacagccagctaaaagagctacagagtcagcatacccattgtgcccaggacctggctatgaaggatgagttactctgccagcttacccagagcaatgaggagcaggctgctcaatggcaaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagactgaacaagagacccttctgctgagtacagcctgtcctcccacccaggaacaccctctgcctaatgacaggaccttcctgggaagcatcttgacagcagtggcagatgaagagccagaatcaactcctgtgcccttgcttggaagtgacaagagtgctttcacccgagtagcatcaatggtttcccttcagcccgcagagaccccaggcatggaggagagcctggcagaaatgagtattatgactactgagcttcagagtctttgttccctgctacaagagtctaaagaagaagccatcaggactctgcagcgaaaaatttgtgagctgcaagctaggctgcaggcccaggaagaacagcatcaggaagtccagaaggcaaaagaagcagacatagagaagctgaaccaggccttgtgcttgcgctacaagaatgaaaaggagctccaggaagtgatacagcagcagaatgagaagatcctagaacagatagacaagagtggcgagctcataagccttagagaggaggtgacccaccttacccgctcacttcggcgtgcggagacagagaccaaagtgctccaggaggccctggcaggccagctggactccaactgccagcctatggccaccaattggatccaggagaaagtgtggctctctcaggaggtgactcagagttaacagaggagctggacagcaggtggggaccccaggctgtacccctgttgatctggacatatttctaggtggacaaactgagagtgatgttcctggagatgaaaaatgagaaggaaaaactcatgatcaagttccagagccatgtaagaatgtccatgccattccagggccatttcctaccatcgttaacaaatgccccgccatgtttcccctgtcctaccaagtttgctcttttatgcataggacttataaaatctgtttgctttctagagaaatatcctagaggagaaccttcggcgctctgacaaggagttagaaaaactagatgacattgttcagcatatttataaggtataggcaggagggaggtgatatcactaatgaacctggtacaaggcctggccccaggaggtactaatgagcacagatctggttcccagcctgtgctgagagctgggcctgaatcactattgcaggcttctctgtggtgtctgttttctcccctctaattcagcggctgcctcctggggctgggagccctgggccttaagtctgtggtcctgagctgcgttttctgcctctcttcccagaccctgctctctattccagaggtggtgaggggatgcaaagaactacagggattgctggaatttctgagctaagaaactgaaagccagaatctgcttcacctctttttacctgcaatacccccttaccccaataccaagaccaactggcatagagccaactgagataaatgctatttaaataaagtgtatttaatgaa

SEQ ID NO: 368946 - DNA, 3454 bp, Homo sapiens
caggagggatggactcctggactctccagctacctgcgtggtcctccccggtgtgaggacagaagaccggtcctggaccgggcccgcatccagccctaccgccggtgtctgaggtgagggctccgtcagcggaaaacgctcgacaacggaggggcaggcagggccgggggcgtggtcaacgcgggccccgccccccgggctctacccccgagcgtacgcgcgcgcctgaagcagccaaccaggaagcgcagagcaggttcaaacacagacggcgggtgaacatggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcagcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattctggaggttctctcccgccagcttcgggactggaagagccagctggctgtccctcacccagaaacccaggacagtagcacacagactgacacatctcacagtgggataactaataaacttcagcatcttaaggagagccatgagatgggacaggccctacagcaggccagaaatgtcatgcaatcatgggtgcttatctctaaagagctgatatccttgcttcacctatccctgttgcatttagaagaagataagactactgtgagtcaggagtctcggcgtgcagaaacattggtctgttgctgttttgatttgctgaagaaattgagggcaaagctccagagcctcaaagcagaaagggaggaggcaaggcacagagaggaaatggctctcagaggcaaggatgcggcagagatagtgttggaggctttctgtgcacacgccagccagcgcatcagccagctggaacaggacctagcatccatgcgggaattcagaggccttctgaaggatgcccagacccaactggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggaggtttctagggtgctggaacaagtctctgcccagttagaggagtgcaaaggccaaacagaacaactggagttggaaaacagtcgtctagcaacagatctccgggctcagttgcagattctggccaacatggacagccagctaaaagagctacagagtcagcatacccattgtgcccaggacctggctatgaaggatgagttactctgccagcttacccagagcaatgaggagcaggctgctcaatggcaaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagactgaacaagagacccttctgctgagtacagcctgtcctcccacccaggaacaccctctgcctaatgacaggaccttcctgggaagcatcttgacagcagtggcagatgaagagccagaatcaactcctgtgcccttgcttggaagtgacaagagtgctttcacccgagtagcatcaatggtttcccttcagcccgcagagaccccaggcatggaggagagcctggcagaaatgagtattatgactactgagcttcagagtctttgttccctgctacaagagtctaaagaagaagccatcaggactctgcagcgaaaaatttgtgagctgcaagctaggctgcaggcccaggaagaacagcatcaggaagtccagaaggcaaaagaagcagacatagagaagctgaaccaggccttgtgcttgcgctacaagaatgaaaaggagctccaggaagtgatacagcagcagaatgagaagatcctagaacagatagacaagagtggcgagctcataagccttagagaggaggtgacccaccttacccgctcacttcggcgtgcggagacagagaccaaagtgctccaggaggccctggcaggccagctggactccaactgccagcctatggccaccaattggatccaggagaaagtgtggctctctcaggaggtggacaaactgagagtgatgttcctggagatgaaaaatgagaaggaaaaactcatgatcaagttccagagccatagaaatatcctagaggagaaccttcggcgctctgacaaggagttagaaaaactagatgacattgttcagcatatttataagaccctgctctctattccagaggtggtgaggggatgcaaagaactacagggattgctggaatttctgagctaagaaactgaaagccagaatctgcttcacctctttttacctgcaatacccccttaccccaataccaagaccaactggcatagagccaactgagataaatgctatttaaataaagtgtatttaatgaa

SEQ ID NO: 368947 - DNA, 3379 bp, Homo sapiens
caggagggatggactcctggactctccagctacctgcgtggtcctccccggtgtgaggacagaagaccggtcctggaccgggcccgcatccagccctaccgccggtgtctgaggtgagggctccgtcagcggaaaacgctcgacaacggaggggcaggcagggccgggggcgtggtcaacgcgggccccgccccccgggctctacccccgagcgtacgcgcgcgcctgaagcagccaaccaggaagcgcagagcaggttcaaacacagacggcgggtgaacatggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcagcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattctggaggttctctcccgccagcttcgggactggaagagccagctggctgtccctcacccagaaacccaggacagtagcacacagactgacacatctcacagtgggcaatcatgggtgcttatctctaaagagctgatatccttgcttcacctatccctgttgcatttagaagaagataagactactgtgagtcaggagtctcggcgtgcagaaacattggtctgttgctgttttgatttgctgaagaaattgagggcaaagctccagagcctcaaagcagaaagggaggaggcaaggcacagagaggaaatggctctcagaggcaaggatgcggcagagatagtgttggaggctttctgtgcacacgccagccagcgcatcagccagctggaacaggacctagcatccatgcgggaattcagaggccttctgaaggatgcccagacccaactggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggaggtttctagggtgctggaacaagtctctgcccagttagaggagtgcaaaggccaaacagaacaactggagttggaaaacagtcgtctagcaacagatctccgggctcagttgcagattctggccaacatggacagccagctaaaagagctacagagtcagcatacccattgtgcccaggacctggctatgaaggatgagttactctgccagcttacccagagcaatgaggagcaggctgctcaatggcaaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagactgaacaagagacccttctgctgagtacagcctgtcctcccacccaggaacaccctctgcctaatgacaggaccttcctgggaagcatcttgacagcagtggcagatgaagagccagaatcaactcctgtgcccttgcttggaagtgacaagagtgctttcacccgagtagcatcaatggtttcccttcagcccgcagagaccccaggcatggaggagagcctggcagaaatgagtattatgactactgagcttcagagtctttgttccctgctacaagagtctaaagaagaagccatcaggactctgcagcgaaaaatttgtgagctgcaagctaggctgcaggcccaggaagaacagcatcaggaagtccagaaggcaaaagaagcagacatagagaagctgaaccaggccttgtgcttgcgctacaagaatgaaaaggagctccaggaagtgatacagcagcagaatgagaagatcctagaacagatagacaagagtggcgagctcataagccttagagaggaggtgacccaccttacccgctcacttcggcgtgcggagacagagaccaaagtgctccaggaggccctggcaggccagctggactccaactgccagcctatggccaccaattggatccaggagaaagtgtggctctctcaggaggtggacaaactgagagtgatgttcctggagatgaaaaatgagaaggaaaaactcatgatcaagttccagagccatagaaatatcctagaggagaaccttcggcgctctgacaaggagttagaaaaactagatgacattgttcagcatatttataagaccctgctctctattccagaggtggtgaggggatgcaaagaactacagggattgctggaatttctgagctaagaaactgaaagccagaatctgcttcacctctttttacctgcaatacccccttaccccaataccaagaccaactggcatagagccaactgagataaatgctatttaaataaagtgtatttaatgaa

SEQ ID NO: 368948 - DNA, 1905 bp, Homo sapiens
caggagggatggactcctggactctccagctacctgcgtggtcctccccggtgtgaggacagaagaccggtcctggaccgggcccgcatccagccctaccgccggtgtctgaggtgagggctccgtcagcggaaaacgctcgacaacggaggggcaggcagggccgggggcgtggtcaacgcgggccccgccccccgggctctacccccgagcgtacgcgcgcgcctgaagcagccaaccaggaagcgcagagcaggttcaaacacagacggcgggtgaacatggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcaggaaggcagcaacaactcatctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattctggaggttctctcccgccagcttcgggactggaagagccagctggctgtccctcacccagaaacccaggacagtagcacacagactgacacatctcacagtgggctaataaacttcagccttcctaaggctcctggactccagaggccagcggggagcctttcctggctccctctgttttctctcactgtagaccaaagagccgcttgtgtgatattaaagccactttaaaaagcaaaa

SEQ ID NO: 368949 - DNA, 1185 bp, Homo sapiens
caggagggatggactcctggactctccagctacctgcgtggtcctccccggtgtgaggacagaagaccggtcctggaccgggcccgcatccagccctaccgccggtgtctgaggtgagggctccgtcagcggaaaacgctcgacaacggaggggcaggcagggccgggggcgtggtcaacgcgggccccgccccccgggctctacccccgagcgtacgcgcgcgcctgaagcagccaaccaggaagcgcagagcaggttcaaacacagacggcgggtgaacatggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcaggaaggcagcaacaactcatctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatttccgtgtcaatcatgtggacccagaggcgagaacgcacgacgaggatctctctagacatcgacccgcagaattcaagctt

SEQ ID NO: 368950 - DNA, 1304 bp, Homo sapiens
caggagggatggactcctggactctccagctacctgcgtggtcctccccggtgtgaggacagaagaccggtcctggaccgggcccgcatccagccctaccgccggtgtctgaggtgagggctccgtcagcggaaaacgctcgacaacggaggggcaggcagggccgggggcgtggtcaacgcgggccccgccccccgggctctacccccgagcgtacgcgcgcgcctgaagcagccaaccaggaagcgcagagcaggttcaaacacagacggcgggtgaacatggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcaggaaggcagcaacaactcatctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattctggaggttctctcccgccagcttcgggactggaagagccagctggctgtccctcacccaccaccgtaggcaagtagaacaaaggttggcacatgggccagtgggaagattgataaccgtcagcctccttaaggatgttggattacataggcgagcggggagctcttcctgggtccatcgggtttagttcatggccgtccaaacatccgagggagggagataaaagccactagataaagcga

SEQ ID NO: 368951 - DNA, 732 bp, Homo sapiens
taagtcccaggaaaagcccagaaactctggagacattacagcccaggtcgagaaccacggcccgggccgtcccggacgcgggcccaccaagcctagggaagccgctcggcaccgcttcggcttctagactccctggccggctctttcccgtcaaggctgcggctggagaggactgagggagacctagggagaggattcctcttctccatccacggagacaacttggatatgaacaccatggatgtgaggaggtccgctggaagcaggagggatggactcctggactctccagctacctgcgtggtcctccccggtgtgaggacagaagaccggtcctggaccgggcccgcatccagccctaccgccggtgtctgaggtgagggctccgtcagcggaaaacgctcgacaacggaggggcaggcagggccgggggcgtggtcaacgcgggccccgccccccgggctctacccccgagcgtacgcgcgcgcctgaagcagccaaccaggaagcgcagagcaggttcaaacacagacggcgggtgaacatggcgtcctcgacttggtctgagacgtgataggcctgccttctggttgaagatgtggcgagtgaaaaaactgagcctcagcctgtcgccttcgccccagacggtaagcgggagatctctggcggagagaactgggccgggctgctgtcgcgggggcaccggccgtgtctactgtcctggaaagttgg

SEQ ID NO: 368952 - DNA, 4040 bp, Homo sapiens
caggagggatggactcctggactctccagctacctgcgtggtcctccccggtgtgaggacagaagaccggtcctggaccgggcccgcatccagccctaccgccggtgtctgaggtgagggctccgtcagcggaaaacgctcgacaacggaggggcaggcagggccgggggcgtggtcaacgcgggccccgccccccgggctctacccccgagcgtacgcgcgcgcctgaagcagccaaccaggaagcgcagagcaggttcaaacacagacggcgggtgaacatggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcaggaaggcagcaacaactcatctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattctggaggttctctcccgccagcttcgggactggaagagccagctggctgtccctcacccagaaacccaggacagtagcacacagactgacacatctcacagtgggataactaataaacttcagcatcttaaggagagccatgagatgggacaggccctacagcaggccagaaatgtcatgcaatcatgggtgcttatctctaaagagctgatatccttgcttcacctatccctgttgcatttagaagaagataagactactgtgagtcaggagtctcggcgtgcagaaacattggtctgttgctgttttgatttgctgaagaaattgagggcaaagctccagagcctcaaagcagaaagggaggaggcaaggcacagagaggaaatggctctcagaggcaaggatgcggcagagatagtgttggaggctttctgtgcacacgccagccagcgcatcagccagctggaacaggacctagcatccatgcgggaattcagaggccttctgaaggatgcccagacccaactggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggaggtttctagggtgctggaacaagtctctgcccagttagaggagtgcaaaggccaaacagaacaactggagttggaaaacagtcgtctagcaacagatctccgggctcagttgcagattctggccaacatggacagccagctaaaagagctacagagtcagcatacccattgtgcccaggacctggctatgaaggatgagttactctgccagcttacccagagcaatgaggagcaggctgctcaatggcaaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagactgaacaagagacccttctgctgagtacagcctgtcctcccacccaggaacaccctctgcctaatgacaggaccttcctgggaagcatcttgacagcagtggcagatgaagagccagaatcaactcctgtgcccttgcttggaagtgacaagagtgctttcacccgagtagcatcaatggtttcccttcagcccgcagagaccccaggcatggaggagagcctggcagaaatgagtattatgactactgagcttcagagtctttgttccctgctacaagagtctaaagaagaagccatcaggactctgcagcgaaaaatttgtgagctgcaagctaggctgcaggcccaggaagaacagcatcaggaagtccagaaggcaaaagaagcagacatagagaagctgaaccaggccttgtgcttgcgctacaagaatgaaaaggagctccaggaagtgatacagcagcagaatgagaagatcctagaacagatagacaagagtggcgagctcataagccttagagaggaggtgacccaccttacccgctcacttcggcgtgcggagacagagaccaaagtgctccaggaggccctggcaggccagctggactccaactgccagcctatggccaccaattggatccaggagaaagtgtggctctctcaggaggtggacaaactgagagtgatgttcctggagatgaaaaatgagaaggaaaaactcatgatcaagttccagagccatagaaatatcctagaggagaaccttcggcgctctgacaaggagttagaaaaactagatgacattgttcagcatatttataagaccctgctctctattccagaggtggtgaggggatgcaaagaactacagggattgctggaatttctgagctaagaaactgaaagccagaatctgcttcacctctttttacctgcaatacccccttaccccaataccaagaccaactggcatagagccaactgagataaatgctatttaaataaagtgtatttaatgaa

SEQ ID NO: 368953 - DNA, 3770 bp, Homo sapiens
aggcgagctcagggaggacagaaacctcccgtgggacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcaggaaggcagcaacaactcatctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattctggaggttctctcccgccagcttcgggactggaagagccagctggctgtccctcacccagaaacccaggacagtagcacacagactgacacatctcacagtgggataactaataaacttcagcatcttaaggagagccatgagatgggacaggccctacagcaggccagaaatgtcatgcaatcatgggtgcttatctctaaagagctgatatccttgcttcacctatccctgttgcatttagaagaagataagactactgtgagtcaggagtctcggcgtgcagaaacattggtctgttgctgttttgatttgctgaagaaattgagggcaaagctccagagcctcaaagcagaaagggaggaggcaaggcacagagaggaaatggctctcagaggcaaggatgcggcagagatagtgttggaggctttctgtgcacacgccagccagcgcatcagccagctggaacaggacctagcatccatgcgggaattcagaggccttctgaaggatgcccagacccaactggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggaggtttctagggtgctggaacaagtctctgcccagttagaggagtgcaaaggccaaacagaacaactggagttggaaaacagtcgtctagcaacagatctccgggctcagttgcagattctggccaacatggacagccagctaaaagagctacagagtcagcatacccattgtgcccaggacctggctatgaaggatgagttactctgccagcttacccagagcaatgaggagcaggctgctcaatggcaaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagactgaacaagagacccttctgctgagtacagcctgtcctcccacccaggaacaccctctgcctaatgacaggaccttcctgggaagcatcttgacagcagtggcagatgaagagccagaatcaactcctgtgcccttgcttggaagtgacaagagtgctttcacccgagtagcatcaatggtttcccttcagcccgcagagaccccaggcatggaggagagcctggcagaaatgagtattatgactactgagcttcagagtctttgttccctgctacaagagtctaaagaagaagccatcaggactctgcagcgaaaaatttgtgagctgcaagctaggctgcaggcccaggaagaacagcatcaggaagtccagaaggcaaaagaagcagacatagagaagctgaaccaggccttgtgcttgcgctacaagaatgaaaaggagctccaggaagtgatacagcagcagaatgagaagatcctagaacagatagacaagagtggcgagctcataagccttagagaggaggtgacccaccttacccgctcacttcggcgtgcggagacagagaccaaagtgctccaggaggccctggcaggccagctggactccaactgccagcctatggccaccaattggatccaggagaaagtgtggctctctcaggaggtggacaaactgagagtgatgttcctggagatgaaaaatgagaaggaaaaactcatgatcaagttccagagccatagaaatatcctagaggagaaccttcggcgctctgacaaggagttagaaaaactagatgacattgttcagcatatttataagaccctgctctctattccagaggtggtgaggggatgcaaagaactacagggattgctggaatttctgagctaagaaactgaaagccagaatctgcttcacctctttttacctgcaatacccccttaccccaataccaagaccaactggcatagagccaactgagataaatgctatttaaataaagtgtatttaatgaa

SEQ ID NO: 368954 - DNA, 4133 bp, Homo sapiens
caggagggatggactcctggactctccagctacctgcgtggtcctccccggtgtgaggacagaagaccggtcctggaccgggcccgcatccagccctaccgccggtgtctgaggtgagggctccgtcagcggaaaacgctcgacaacggaggggcaggcagggccgggggcgtggtcaacgcgggccccgccccccgggctctacccccgagcgtacgcgcgcgcctgaagcagccaaccaggaagcgcagagcaggttcaaacacagacggcgggtgaacatggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcaggaaggcagcaacaactcatctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattctggaggttctctcccgccagcttcgggactggaagagccagctggctgtccctcacccagaaacccaggacagtagcacacagactgacacatctcacagtgggataactaataaacttcagcatcttaaggagagccatgagatgggacaggccctacagcaggccagaaatgtcatgcaatcatgggtgcttatctctaaagagctgatatccttgcttcacctatccctgttgcatttagaagaagataagactactgtgagtcaggagtctcggcgtgcagaaacattggtctgttgctgttttgatttgctgaagaaattgagggcaaagctccagagcctcaaagcagaaagggaggaggcaaggcacagagaggaaatggctctcagaggcaaggatgcggcagagatagtgttggaggctttctgtgcacacgccagccagcgcatcagccagctggaacaggacctagcatccatgcgggaattcagaggccttctgaaggatgcccagacccaactggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggaggtttctagggtgctggaacaagtctctgcccagttagaggagtgcaaaggccaaacagaacaactggagttggaaaacagtcgtctagcaacagatctccgggctcagttgcagattctggccaacatggacagccagctaaaagagctacagagtcagcatacccattgtgcccaggacctggctatgaaggatgagttactctgccagcttacccagagcaatgaggagcaggctgctcaatggcaaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagactatgtttcaagaaagcagaaatatagccttctttggcctccctgcagtgtgcactaaacaataaatggttgacatcattcagaatacaaagactgaacaagagacccttctgctgagtacagcctgtcctcccacccaggaacaccctctgcctaatgacaggaccttcctgggaagcatcttgacagcagtggcagatgaagagccagaatcaactcctgtgcccttgcttggaagtgacaagagtgctttcacccgagtagcatcaatggtttcccttcagcccgcagagaccccaggcatggaggagagcctggcagaaatgagtattatgactactgagcttcagagtctttgttccctgctacaagagtctaaagaagaagccatcaggactctgcagcgaaaaatttgtgagctgcaagctaggctgcaggcccaggaagaacagcatcaggaagtccagaaggcaaaagaagcagacatagagaagctgaaccaggccttgtgcttgcgctacaagaatgaaaaggagctccaggaagtgatacagcagcagaatgagaagatcctagaacagatagacaagagtggcgagctcataagccttagagaggaggtgacccaccttacccgctcacttcggcgtgcggagacagagaccaaagtgctccaggaggccctggcaggccagctggactccaactgccagcctatggccaccaattggatccaggagaaagtgtggctctctcaggaggtggacaaactgagagtgatgttcctggagatgaaaaatgagaaggaaaaactcatgatcaagttccagagccatagaaatatcctagaggagaaccttcggcgctctgacaaggagttagaaaaactagatgacattgttcagcatatttataagaccctgctctctattccagaggtggtgaggggatgcaaagaactacagggattgctggaatttctgagctaagaaactgaaagccagaatctgcttcacctctttttacctgcaatacccccttaccccaataccaagaccaactggcatagagccaactgagataaatgctatttaaataaagtgtatttaatgaa

SEQ ID NO: 368955 - DNA, 4021 bp, Homo sapiens
caggagggatggactcctggactctccagctacctgcgtggtcctccccggtgtgaggacagaagaccggtcctggaccgggcccgcatccagccctaccgccggtgtctgaggtgagggctccgtcagcggaaaacgctcgacaacggaggggcaggcagggccgggggcgtggtcaacgcgggccccgccccccgggctctacccccgagcgtacgcgcgcgcctgaagcagccaaccaggaagcgcagagcaggttcaaacacagacggcgggtgaacatggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcaggaaggcagcaacaactcatctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattctggaggttctctcccgccagcttcgggactggaagagccagctggctgtccctcacccagaaacccaggacagtagcacacagactgacacatctcacagtgggataactaataaacttcagcatcttaaggagagccatgagatgggacaggccctacagcaggccagaaatgtcatgcaatcatgggtgcttatctctaaagagctgatatccttgcttcacctatccctgttgcatttagaagaagataagactactgtgagtcaggagtctcggcgtgcagaaacattggtctgttgctgttttgatttgctgaagaaattgagggcaaagctccagagcctcaaagcagaaagggaggaggcaaggcacagagaggaaatggctctcagaggcaaggatgcggcagagatagtgttggaggctttctgtgcacacgccagccagcgcatcagccagctggaacaggacctagcatccatgcgggaattcagaggccttctgaaggatgcccagacccaactggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggaggtttctagggtgctggaacaagtctctgcccagttagaggagtgcaaaggccaaacagaacaactggagttggaaaacagtcgtctagcaacagatctccgggctcagttgcagattctggccaacatggacagccagctaaaagagctacagagtcagcatacccattgtgcccaggacctggctatgaaggatgagttactctgccagcttacccagagcaatgaggagcaggctgctcaatggcaaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagactgaacaagagacccttctgctgagtacagcctgtcctcccacccaggaacaccctctgcctaatgacaggaccttcctgggaagcatcttgacagcagtggcagatgaagagccagaatcaactcctgtgcccttgcttggaagtgacaagagtgctttcacccgagtagcatcaatggtttcccttcagcccgcagagaccccaggcatggaggagagcctggcagaaatgagtattatgactactgagcttcagagtctttgttccctgctacaagagtctaaagaagaagccatcaggactctgcagcgaaaaatttgtgagctgcaagctaggctgcaggcccaggaagaacagcatcaggaagtccagaaggcaaaagaagcagacatagagaagctgaaccaggccttgtgcttgcgctacaagaatgaaaaggagctccaggaagtgatacagcagcagaatgagaagatcctagaacagatagacaagagtggcgagctcataagccttagagaggaggtgacccaccttacccgctcacttcggcgtgcggagacagagaccaaagtgctccaggaggccctggcaggccagctggactccaactgccagcctatggccaccaattggatccaggagaaagtgtggctctctcaggaggtggacaaactgagagtgatgttcctggagatgaaaaatgagaaggaaaaactcatgatcaagttccagagccatagaaatatcctagaggagaaccttcggcgctctgacaaggagttagaaaaactagatgacattgttcagcatatttataagaggtggtgaggggatgcaaagaactacagggattgctggaatttctgagctaagaaactgaaagccagaatctgcttcacctctttttacctgcaatacccccttaccccaataccaagaccaactggcatagagccaactgagataaatgctatttaaataaagtgtatttaatgaa

SEQ ID NO: 368956 - DNA, 4247 bp, Homo sapiens
caggagggatggactcctggactctccagctacctgcgtggtcctccccggtgtgaggacagaagaccggtcctggaccgggcccgcatccagccctaccgccggtgtctgaggtgagggctccgtcagcggaaaacgctcgacaacggaggggcaggcagggccgggggcgtggtcaacgcgggccccgccccccgggctctacccccgagcgtacgcgcgcgcctgaagcagccaaccaggaagcgcagagcaggttcaaacacagacggcgggtgaacatggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcaggaaggcagcaacaactcatctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattctggaggttctctcccgccagcttcgggactggaagagccagctggctgtccctcacccagaaacccaggacagtagcacacagactgacacatctcacagtgggataactaataaacttcagcatcttaaggagagccatgagatgggacaggccctacagcaggccagaaatgtcatgcaatcatgggtgcttatctctaaagagctgatatccttgcttcacctatccctgttgcatttagaagaagataagactactgtgagtcaggagtctcggcgtgcagaaacattggtctgttgctgttttgatttgctgaagaaattgagggcaaagctccagagcctcaaagcagaaagggaggaggcaaggcacagagaggaaatggctctcagaggcaaggatgcggcagagatagtgttggaggctttctgtgcacacgccagccagcgcatcagccagctggaacaggacctagcatccatgcgggaattcagaggccttctgaaggatgcccagacccaactggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggaggtttctagggtgctggaacaagtctctgcccagttagaggagtgcaaaggccaaacagaacaactggagttggaaaacagtcgtctagcaacagatctccgggctcagttgcagattctggccaacatggacagccagctaaaagagctacagagtcagcatacccattgtgcccaggacctggctatgaaggatgagttactctgccagcttacccagagcaatgaggagcaggctgctcaatggcaaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagactgaacaagagacccttctgctgagtacagcctgtcctcccacccaggaacaccctctgcctaatgacaggaccttcctgggaagcatcttgacagcagtggcagatgaagagccagaatcaactcctgtgcccttgcttggaagtgacaagagtgctttcacccgagtagcatcaatggtttcccttcagcccgcagagaccccaggcatggaggagagcctggcagaaatgagtattatgactactgagcttcagagtctttgttccctgctacaagagtctaaagaagaagccatcaggactctgcagcgaaaaatttgtgagctgcaagctaggctgcaggcccaggaagaacagcatcaggaagtccagaaggcaaaagaagcagacatagagaagctgaaccaggccttgtgcttgcgctacaagaatgaaaaggagctccaggaagtgatacagcagcagaatgagaagatcctagaacagatagacaagagtggcgagctcataagccttagagaggaggtgacccaccttacccgctcacttcggcgtgcggagacagagaccaaagtgctccaggaggccctggcaggccagctggactccaactgccagcctatggccaccaattggatccaggagaaagtgtggctctctcaggaggtgactcagagttaacagaggagctggacagcaggtggggaccccaggctgtacccctgttgatctggacatatttctaggtggacaaactgagagtgatgttcctggagatgaaaaatgagaaggaaaaactcatgatcaagttccagagccatgtaagaatgtccatgccattccagggccatttcctaccatcgttaacaaatgccccgccatgtttcccctgtcctaccaagtttgctcttttatgcataggacttataaaatctgtttgctttctagagaaatatcctagaggagaaccttcggcgctctgacaaggagttagaaaaactagatgacattgttcagcatatttataagaccctgctctctattccagaggtggtgaggggatgcaaagaactacagggattgctggaatttctgagctaagaaactgaaagccagaatctgcttcacctctttttacctgcaatacccccttaccccaataccaagaccaactggcatagagccaactgagataaatgctatttaaataaagtgtatttaatgaa

SEQ ID NO: 368957 - DNA, 4109 bp, Homo sapiens
  misc_feature (2538)..(2538): n is a, c, g, or t
caggagggatggactcctggactctccagctacctgcgtggtcctccccggtgtgaggacagaagaccggtcctggaccgggcccgcatccagccctaccgccggtgtctgaggtgagggctccgtcagcggaaaacgctcgacaacggaggggcaggcagggccgggggcgtggtcaacgcgggccccgccccccgggctctacccccgagcgtacgcgcgcgcctgaagcagccaaccaggaagcgcagagcaggttcaaacacagacggcgggtgaacatggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcaggaaggcagcaacaactcatctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattctggaggttctctcccgccagcttcgggactggaagagccagctggctgtccctcacccagaaacccaggacagtagcacacagactgacacatctcacagtgggataactaataaacttcagcatcttaaggagagccatgagatgggacaggccctacagcaggccagaaatgtcatgcaatcatgggtgcttatctctaaagagctgatatccttgcttcacctatccctgttgcatttagaagaagataagactactgtgagtcaggagtctcggcgtgcagaaacattggtctgttgctgttttgatttgctgaagaaattgagggcaaagctccagagcctcaaagcagaaagggaggaggcaaggcacagagaggaaatggctctcagaggcaaggatgcggcagagatagtgttggaggctttctgtgcacacgccagccagcgcatcagccagctggaacaggacctagcatccatgcgggaattcagaggccttctgaaggatgcccagacccaactggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggaggtttctagggtgctggaacaagtctctgcccagttagaggagtgcaaaggccaaacagaacaactggagttggaaaacagtcgtctagcaacagatctccgggctcagttgcagattctggcccggagatctgcaacngatctccgggctcagttgcagattctggccaacatggacagccagctaaaagagctacagagtcagcatacccattgtgcccaggacctggctatgaaggatgagttactctgccagcttacccagagcaatgaggagcaggctgctcaatggcaaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagctattttttcttctttgcccttagactgaacaagagacccttctgctgagtacagcctgtcctcccacccaggaacaccctctgcctaatgacaggaccttcctgggaagcatcttgacagcagtggcagatgaagagccagaatcaactcctgtgcccttgcttggaagtgacaagagtgctttcacccgagtagcatcaatggtttcccttcagcccgcagagaccccaggcatggaggagagcctggcagaaatgagtattatgactactgagcttcagagtctttgttccctgctacaagagtctaaagaagaagccatcaggactctgcagcgaaaaatttgtgagctgcaagctaggctgcaggcccaggaagaacagcatcaggaagtccagaaggcaaaagaagcagacatagagaagctgaaccaggccttgtgcttgcgctacaagaatgaaaaggagctccaggaagtgatacagcagcagaatgagaagatcctagaacagatagacaagagtggcgagctcataagccttagagaggaggtgacccaccttacccgctcacttcggcgtgcggagacagagaccaaagtgctccaggaggccctggcaggccagctggactccaactgccagcctatggccaccaattggatccaggagaaagtgtggctctctcaggaggtggacaaactgagagtgatgttcctggagatgaaaaatgagaaggaaaaactcatgatcaagttccagagccatagaaatatcctagaggagaaccttcggcgctctgacaaggagttagaaaaactagatgacattgttcagcatatttataagaccctgctctctattccagaggtggtgaggggatgcaaagaactacagggattgctggaatttctgagctaagaaactgaaagccagaatctgcttcacctctttttacctgcaatacccccttaccccaataccaagaccaactggcatagagccaactgagataaatgctatttaaataaagtgtatttaatgaa

SEQ ID NO: 368958 - DNA, 2718 bp, Homo sapiens
caggagggatggactcctggactctccagctacctgcgtggtcctccccggtgtgaggacagaagaccggtcctggaccgggcccgcatccagccctaccgccggtgtctgaggtgagggctccgtcagcggaaaacgctcgacaacggaggggcaggcagggccgggggcgtggtcaacgcgggccccgccccccgggctctacccccgagcgtacgcgcgcgcctgaagcagccaaccaggaagcgcagagcaggttcaaacacagacggcgggtgaacatggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcaggaaggcagcaacaactcatctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattctggaggttctctcccgccagcttcgggactggaagagccagctggctgtccctcacccagaaacccaggacagtagcacacagactgacacatctcacagtgggataactaataaacttcagcatcttaaggagagccatgagatgggacaggccctacagcaggccagaaatgtcatgcaatcatgggtgcttatctctaaagagctgatatccttgcttcacctatccctgttgcatttagaagaagataagactactgtgagtcaggagtctcggcgtgcagaaacattggtctgttgctgttttgatttgctgaagaaattgagggcaaagctccagagcctcaaagcagaaagggaggaggcaaggcacagagaggaaatggctctcagaggcaaggatgcggcagagatagtgttggaggctttctgtgcacacgccagccagcgcatcagccagctggaacaggacctagcatccatgcgggaattcagaggccttctgaaggatgcccagacccaactggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggaggtttctagggtgctggaacaagtctctgcccagttagaggagtgcaaaggccaaacagaacaactggagttggaaaacagtcgtctagcaacagatctccgggctcagttgcagattctgtcctgaaatattataaggtggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaaagacatgaactaaa

SEQ ID NO: 368959 - DNA, 952 bp, Homo sapiens
atcatcagaggggccctctcccattattggtttttctcttagagccagaatcaactcctgtgcccttgcttggaagtgacaagagtgctttcacccgagtagcatcaatggtttcccttcagcccgcagagaccccaggcatggaggagagcctggcagaaatgagtattatgactactgagcttcagagtctttgttccctgctacaagagtctaaagaagaagccatcaggactctgcagcgaaaaatttgtgagctgcaagctaggctgcaggcccaggaagaacagcatcaggaagtccagaaggcaaaagaagcagacatagagaagctgaaccaggccttgtgcttgcgctacaagaatgaaaaggagctccaggaagtgatacagcagcagaatgagaagatcctagaacagatagacaagagtggcgagctcataagccttagagaggaggtgacccaccttacccgctcacttcggcgtgcggagacagagaccaaagtgctccaggaggccctggcaggccagctggactccaactgccagcctatggccaccaattggatccaggagaaagtgtggctctctcaggaggtggacaaactgagagtgatgttcctggagatgaaaaatgagaaggaaaaactcatgatcaagttccagagccatagaaatatcctagaggagaaccttcggcgctctgacaaggagttagaaaaactagatgacattgttcagcatatttataagaccctgctctctattccagaggtggtgaggggatgcaaagaactacagggattgctggaatttctgagctaagaaactgaaagccagaatctgcttcacctctttttacctgcaatacccccttaccccaataccaagaccaactggcatagagccaactgagataaatgctatttaaataaagtgtatttaatgaa

SEQ ID NO: 368960 - DNA, 630 bp, Homo sapiens
aggcgagctcagggaggacagaaacctcccgtgggacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcagcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctgcaatacccccttaccccaataccaagaccaactggcatagagccaactgagataaatgctatttaaataaagtgtatttaatgaa

SEQ ID NO: 368961 - DNA, 3244 bp, Homo sapiens
  misc_feature (2925)..(2925): n is a, c, g, or t
tctcactagcctcagagcactctcagaagttcagaaactaagaccagaaaagagaagatttttagacagctcatgaaacggtctgcgcggggcggccattggcggcggagtgtcacgtgaccgcgggggcgtgccaatgtgcgccctcacgggtgtcaaacccctgtcagagtgtgcgatcaagatcgtgaaacaacgcgatgcaaaaagcgacctactacgacagctcggcgatctacggtggctacccctaccaggcagccaacgggttcgcttataatgccaatcagcagccgtacccggcgtccgccgctttgggcgccgacggcgagtaccaccgacccgcctgctccctccagtctccctccagcgccgggggccaccccaaggcacacgaactgagtgaggcgtgcctgcgcaccctgagcgccccacctagccagcctccaagcctgggagagccgcccctgcacccgccgccgccccaggccgcgccccctgccccacagccgcctcagcccgcacctcagccccctgcacctacccctgccgcgcccccgcctccctcttctgcctcccctcctcagaatgccagcaacaaccctacccctgccaacgcggccaagagccccctgctcaactcacccacagtggccaaacaaatcttcccctggatgaaagagtctcgacaaaacacaaagcagaaaaccagcagctccagctcaggcgaaagctgcgctggcgacaagagcccgccggggcaggcttcgtccaagcgcgcgcgcacggcctacacgagcgcgcagctggtggagctggagaaagagttccacttcaaccgctacctgtgccggccgcgccgggtggagatggccaatctgctgaacctcactgagcgccagatcaagatctggttccagaatcgccgcatgaagtacaaaaaggatcagaagggcaagggcatgctaacgtcatcggggggccagtctccaagtcgcagccccgtgccccccggagccggtggctatctgaactctatgcattcgctggtcaacagcgtcccgtatgagccccagtcgcccccgcccttctccaagcccccccagggtacctacgggctgccccccgcctcctaccctgcgtccctgcccagctgcgcacccccgccacccccacagaagcgctacacggcggcaggggcgggcgcagggggcacccccgactatgacccgcacgctcatggcctgcagggcaacggcagctatgggaccccacacatacagggaagccccgtcttcgtggggggcagctatgtggagcccatgagcaactccgggccagccctctttggtctaactcacctcccccacgctgcctcgggcgccatggactatgggggtgccgggccgctgggcagcggccaccaccacgggccggggcctggggagccgcaccccacctacacggaccttaccggccaccatccttctcagggaagaattcaggaagcacccaagctcacccacctgtgatagtgggcttggggctacgcgccaggagagtctccccccacccaccttttttctttggttgcttttttttttttttttaggttcttcctgccctttccttccttccttttctctcttctccgccccgcactccgtttcccggtttcccccctcgttggtaaggcgtttttatagtttatgtgacgtagcaatcttggttgctggaatggctgtatcatagcgatatttatctcttcctgctcctcgataggccactggccctgcaccctttaccttctccactctttgatcagaaacagggtatatgaacaaattttctagtcgagttttcaatgtgaatttgttcttacattatggctcccgaggggaagcgattactttttttaattttaaatttttttttttaattgcacttcttgtaaagagtgagaaaaaaaatcaaaggcgctttgaaacaggggctctctgtgcaaggatgactaagtgtacgtctttccgtgtgtgtatgctggtgaacagtcagatttatttatatttttttgcaagcattgaataatctaagttttaaatattatttatccccatccgttcgtatttatattaaagaattctgtaccctgatggttcagaagggttcttgggccttttgttcaattgtgtattggcgtacttagaattttttttatttgaaagagaaatataattcctttaaacggtaacgatgcaataaaaccagagaagatccagcttttgaaaacagtgatttaggtttgtaacatccggcaaaactgaaaaaaaaaatctgtaaacgcgaaaaatactagatttgttttgagagttcttcattccttgctgctcacattctgagaaacaaaaagaaataaagtttttattctgaataatatccgtgttaagaaggggttctttggccgaagacgtgggtctgcgtggaattcaggccgaggcgagccggcagagcaggccggacgcagcagccctctggctccagcatggggcctggccaggctattcgcctggaagctcggcgaattctcaggatggcggctggggctccaggcggctgcggcagctctggtaacgccgtgcggcgggccagctgggctgcccggttcccagctgctgcggaggcaggctgagggcgcaggggctgccgagtgctgtgcacggaagaaacaaagacatcccggcccaaggcgcagcgggagcgcacaggtgccccgcggcccagccgggggataacgcagggcggtcttctgctccatgctcttcctcgggtcaaagcggaccaactaacgcctaaacctcggtattagccagccgcgcagaggatgccgagcactttccgggagcaatcggactcctggtctcctcnggggatgcttcgcggtctgttatcgcgtcaggaggaaagaattgctccaaaaatctgcacgcggagcgaaacagtttgaaagggactgaggctcacccaggtctccagcaaacggaggactgaactggggagagtcaccctgagccagcccttccctggactgccggaatcccagcattagcttcctgctgaatgtagtatttggcattctctgaatttatttcctctccttcccccacccagctttctttttatggccccagggggagggggagagagcaaggagatcggtatctttgtaataaaactgcaattttat

SEQ ID NO: 368962 - DNA, 401 bp, Homo sapiens
caatggcaggtcccagaagaccaagtagctaccagcaacttctggtactgcacaacacagtacagacaatgtgaaacaatctctaagtctaaagaaggacaatatgagcagcacaggaactgccatctctcattctctctttttttttttaagagacagggtctccctctgttgcccaggctggagggcagtggtgcaatcactcgctgggctcaagtgatcctcccacctcagcctcctgagtagctagaactacaggtgtcaccaagtccaggtaaataaaaaaaaaattttttttgtacagatggggtgttgcccaggctggtccttaaacaattagcctcaagcagtcctcccacctcagcctcccaaagtgctgagattacaggcgtaatgtggcc

SEQ ID NO: 368963 - DNA, 1375 bp, Homo sapiens
agggctcccagacatcacctctgcccgccgccacctcctccaactctcccagctcagccggagccggagcgcgcaacaaccaagtccgagactggaggcagatcggggggaggggagaagcgccaagcgcgctgccctcccagggaaactcactgccgcctactcccagccggccacagtcaccagctcaaaatggcgacgacgagaagggagtcggcgctccgaccaccatccacctactaaggaagcgcgctctggccggccccggcgattggtcaccgcccgctaggggacagccctggcctcctctgattggcaagcgctggccacctccccacaccccttgcgaacgctcccctagtggagaaaaggagtagctattagccaattcggcagggcccgctttttagaagcttgatttcctttgaagatgaaagactagcggaagctctgcctctttccccagtgggcgagggaactcggggcgattggctgggaactgtatccacccaaatgtcaccgatttcttcctatgcaggaaatgagcagacccatcaataagaaatttctcagcctggccgaaaatggttggccccacgaagccacgacaactggaggcaaagagggttgctcaacgccccgcctcattggaaaaccaaatcagatctgggacctatatagcgtggcggaggcggggcgatgattgtcgcgctcgcacccactgcagctgcgcacagtcgcatttctttccccgcccctgagaccctgcagcaccatctgtcatggcggctgggctgtttggtttgagcgctcgccgtcttttggcggcagcggcgacgcgagggctcccggccgcccgcgtccgctgggaatctagcttctccaggactgtggtcgccccgtccgctgtggcgggaaagcggcccccagaaccgaccacaccgtggcaagaggacccagaacccgaggacgaaaacttgtatgagaagaacccagactcccatggttatgacaaggaccccgttttggacgtctggaacatgcgacttgtcttcttctttggcgtctccatcatcctggtccttggcagcacctttgtggcctatctgcctgactacaggtgcacagggtgtccaagagcgtgggatgggatgaaagagtggtcccgccgcgaagctgagaggcttgtgaaataccgagaggccaatggccttcccatcatggaatccaactgcttcgaccccagcaagatccagctgccagaggatgagtgaccagttgctaagtggggctcaagaagcaccgccttccccaccccctgcctgccattctgacctcttctcagagcacctaattaaaggggctgaaagtctga

SEQ ID NO: 368964 - DNA, 1602 bp, Homo sapiens
agggctcccagacatcacctctgcccgccgccacctcctccaactctcccagctcagccggagccggagcgcgcaacaaccaagtccgagactggaggcagatcggggggaggggagaagcgccaagcgcgctgccctcccagggaaactcactgccgcctactcccagccggccacagtcaccagctcaaaatggcgacgacgagaagggagtcggcgctccgaccaccatccacctactaaggaagcgcgctctggccggccccggcgattggtcaccgcccgctaggggacagccctggcctcctctgattggcaagcgctggccacctccccacaccccttgcgaacgctcccctagtggagaaaaggagtagctattagccaattcggcagggcccgctttttagaagcttgatttcctttgaagatgaaagactagcggaagctctgcctctttccccagtgggcgagggaactcggggcgattggctgggaactgtatccacccaaatgtcaccgatttcttcctatgcaggaaatgagcagacccatcaataagaaatttctcagcctggccgaaaatggttggccccacgaagccacgacaactggaggcaaagagggttgctcaacgccccgcctcattggaaaaccaaatcagatctgggacctatatagcgtggcggaggcggggcgatgattgtcgcgctcgcacccactgcagctgcgcacagtcgcatttctttccccgcccctgagaccctgcagcaccatctgtcatggcggctgggctgtttggtttgagcgctcgccgtcttttggcggcagcggcgacgcgagggctcccggccgcccgcgtccgctgggaatctagcttctccaggactgtggtcgccccgtccgctgtggcgggaaagcggcccccagaaccgaccacaccgtggcaagaggacccagaacccgaggacgaaaacttgtatgagaagaacccagactcccatggttatgacaaggaccccgttttggacgtctggaacatgcgacttgtcttcttctttggcgtctccatcatcctggtccttggcagcacctttgtggcctatctgcctgactacaggatgaaagagtggtcccgccgcgaagctgagaggcttgtgaaataccgagaggccaatggccttcccatcatggaatccaactgcttcgaccccagcaagatccagctgccagaggatgagtgaccagttgctaagtggggctcaagaagcaccgccttccccaccccctgcctgccattctgacctcttctcagagcacctaattaaaggggctgaaagtctgaaaaaagataggacaaactccacaccgcgcttcaacctcaacccaagagtgaggcggacgccgacaatcctctgcgagcttctcacacgcgggggacacaggaaactcagcaggagaggcagcgtgtggtgaccaccccttggagaacggtgatgtccggccgctggatcatcggcaccggcaatgcccgggcaagttgccgcgaaaccgggcgggggcccctgggatccgccgaaggcggcgacaacacggtcagag

SEQ ID NO: 368965 - DNA, 1341 bp, Homo sapiens
  misc_feature (1299)..(1299): n is a, c, g, or t
  misc_feature (1302)..(1302): n is a, c, g, or t
agggctcccagacatcacctctgcccgccgccacctcctccaactctcccagctcagccggagccggagcgcgcaacaaccaagtccgagactggaggcagatcggggggaggggagaagcgccaagcgcgctgccctcccagggaaactcactgccgcctactcccagccggccacagtcaccagctcaaaatggcgacgacgagaagggagtcggcgctccgaccaccatccacctactaaggaagcgcgctctggccggccccggcgattggtcaccgcccgctaggggacagccctggcctcctctgattggcaagcgctggccacctccccacaccccttgcgaacgctcccctagtggagaaaaggagtagctattagccaattcggcagggcccgctttttagaagcttgatttcctttgaagatgaaagactagcggaagctctgcctctttccccagtgggcgagggaactcggggcgattggctgggaactgtatccacccaaatgtcaccgatttcttcctatgcaggaaatgagcagacccatcaataagaaatttctcagcctggccgaaaatggttggccccacgaagccacgacaactggaggcaaagagggttgctcaacgccccgcctcattggaaaaccaaatcagatctgggacctatatagcgtggcggaggcggggcgatgattgtcgcgctcgcacccactgcagctgcgcacagtcgcatttctttccccgcccctgagaccctgcagcaccatctgtcatggcggctgggctgtttggtttgagcgctcgccgtcttttggcggcagcggcgacgcgagggctcccggccgcccgcgtccgctgggaatctagcttctccaggactgtggtcgccccgtccgctgtggcgggaaagcggcccccagaaccgaccacaccgtggcaagaggacccagaacccgaggacgaaaacttgtatgagaagaacccagactcccatggttatgacaaggaccccgttttggacgtctggaacatgcgacttgtcttcttctttggcgtctccatcatcctggtccttggcagcacctttgtggcctatctgcctgactacaggatgaaagagtggtcccgccgcgaagctgagaggcttgtgaaataccgagaggccaatggccttcccatcatggaatccaactgcttcgaccccagcaagatccagctgccagaggatgagtgaccagttgctaagtggggctcaagaagcaccgccttccccaccccctgcctgcccnctngtgcatacccagcagtccaagtgcaacgtctcctccata

SEQ ID NO: 368966 - DNA, 1518 bp, Homo sapiens
agggctcccagacatcacctctgcccgccgccacctcctccaactctcccagctcagccggagccggagcgcgcaacaaccaagtccgagactggaggcagatcggggggaggggagaagcgccaagcgcgctgccctcccagggaaactcactgccgcctactcccagccggccacagtcaccagctcaaaatggcgacgacgagaagggagtcggcgctccgaccaccatccacctactaaggaagcgcgctctggccggccccggcgattggtcaccgcccgctaggggacagccctggcctcctctgattggcaagcgctggccacctccccacaccccttgcgaacgctcccctagtggagaaaaggagtagctattagccaattcggcagggcccgctttttagaagcttgatttcctttgaagatgaaagactagcggaagctctgcctctttccccagtgggcgagggaactcggggcgattggctgggaactgtatccacccaaatgtcaccgatttcttcctatgcaggaaatgagcagacccatcaataagaaatttctcagcctggccgaaaatggttggccccacgaagccacgacaactggaggcaaagagggttgctcaacgccccgcctcattggaaaaccaaatcagatctgggacctatatagcgtggcggaggcggggcgatgattgtcgcgctcgcacccactgcagctgcgcacagtcgcatttctttccccgcccctgagaccctgcagcaccatctgtcatggcggctgggctgtttggtttgagcgctcgccgtcttttggcggcagcggcgacgcgagggctcccggccgcccgcgtccgctgggaatctagcttctccaggactgtggtcgccccgtccgctgtggcgggaaagcggcccccagaaccgaccacaccgtggcaagaggacccagaacccgaggacgaaaacttgtatgagaagaacccagactcccatggttatgacaaggaccccgttttggacgtctggaacatgcgacttgtcttcttctttggcgtctccatcatcctggtccttggcagcacctttgtggcctatctgcctgactacaggtgcacagggtgtccaagagcgtgggatgggtaagaggcagaggcagggatggaggttgaaggggattctgccaggagttttgttcctgcaccattgggaatggggagctgagatgagggattggtatcagttgaggctccctcacgtctacccctgctatttgcactaccaggatgaaagagtggtcccgccgcgaagctgagaggcttgtgaaataccgagaggccaatggccttcccatcatggaatccaactgcttcgaccccagcaagatccagctgccagaggatgagtgaccagttgctaagtggggctcaagaagcaccgccttccccaccccctgcctgccattctgacctcttctcagagcacctaattaaaggggctgaaagtctga

SEQ ID NO: 368967 - DNA, 1345 bp, Homo sapiens
agggctcccagacatcacctctgcccgccgccacctcctccaactctcccagctcagccggagccggagcgcgcaacaaccaagtccgagactggaggcagatcggggggaggggagaagcgccaagcgcgctgccctcccagggaaactcactgccgcctactcccagccggccacagtcaccagctcaaaatggcgacgacgagaagggagtcggcgctccgaccaccatccacctactaaggaagcgcgctctggccggccccggcgattggtcaccgcccgctaggggacagccctggcctcctctgattggcaagcgctggccacctccccacaccccttgcgaacgctcccctagtggagaaaaggagtagctattagccaattcggcagggcccgctttttagaagcttgatttcctttgaagatgaaagactagcggaagctctgcctctttccccagtgggcgagggaactcggggcgattggctgggaactgtatccacccaaatgtcaccgatttcttcctatgcaggaaatgagcagacccatcaataagaaatttctcagcctggccgaaaatggttggccccacgaagccacgacaactggaggcaaagagggttgctcaacgccccgcctcattggaaaaccaaatcagatctgggacctatatagcgtggcggaggcggggcgatgattgtcgcgctcgcacccactgcagctgcgcacagtcgcatttctttccccgcccctgagaccctgcagcaccatctgtcatggcggctgggctgtttggtttgagcgctcgccgtcttttggcggcagcggcgacgcgagggctcccggccgcccgcgtccgctgggaatctagcttctccaggactgtggtcgccccgtccgctgtggcgggaaagcggcccccagaaccgaccacaccgtggcaagaggacccagaacccgaggacgaaaacttgtatgagaagaacccagactcccatggttatgacaaggaccccgttttggacgtctggaacatgcgacttgtcttcttctttggcgtctccatcatcctggtccttggcagcacctttgtggcctatctgcctgactacaggatgaaagagtggtcccgccgcgaagctgagaggcttgtgaaataccgagaggccaatggccttcccatcatggaatccaactgcttcgaccccagcaagatccagctgccagaggatgagtgaccagttgctaagtggggctcaagaagcaccgccttccccaccccctgcctgccattctgacctcttctcagagcacctaattaaaggggctgaaagtctga

SEQ ID NO: 368968 - DNA, 1714 bp, Homo sapiens
agggctcccagacatcacctctgcccgccgccacctcctccaactctcccagctcagccggagccggagcgcgcaacaaccaagtccgagactggaggcagatcggggggaggggagaagcgccaagcgcgctgccctcccagggaaactcactgccgcctactcccagccggccacagtcaccagctcaaaatggcgacgacgagaagggagtcggcgctccgaccaccatccacctactaaggaagcgcgctctggccggccccggcgattggtcaccgcccgctaggggacagccctggcctcctctgattggcaagcgctggccacctccccacaccccttgcgaacgctcccctagtggagaaaaggagtagctattagccaattcggcagggcccgctttttagaagcttgatttcctttgaagatgaaagactagcggaagctctgcctctttccccagtgggcgagggaactcggggcgattggctgggaactgtatccacccaaatgtcaccgatttcttcctatgcaggaaatgagcagacccatcaataagaaatttctcagcctggccgaaaatggttggccccacgaagccacgacaactggaggcaaagagggttgctcaacgccccgcctcattggaaaaccaaatcagatctgggacctatatagcgtggcggaggcggggcgatgattgtcgcgctcgcacccactgcagctgcgcacagtcgcatttctttccccgcccctgagaccctgcagcaccatctgtcatggcggctgggctgtttggtttgagcgctcgccgtcttttggcggcagcggcgacgcgagggctcccggccgcccgcgtccgctgggaatctagcttctccaggactgtggtcgccccgtccgctgtggcgggaaagcggcccccagaaccgaccacaccgtggcaagaggacccagaacccgaggacgaaaacttgtatgagaagaacccagactcccatggttatgacaaggaccccgttttggacgtctggaacatgcgacttgtcttcttctttggcgtctccatcatcctggtccttggcagcacctttgtggcctatctgcctgactacaggatgaaagagtggtcccgccgcgaagctgagaggcttgtgaaataccgagaggccaatggccttcccatcatggaatccaactgcttcgaccccagcaagatccagctgccagaggatgagtgaccagttgctaagtggggctcaagaagcaccgccttccccaccccctgcctgccattctgacctcttctcagagcacctaattaaaggggctgaaagtctgaaaaaaaaacaaaaaaaattcgaactagttctctcgaaggggaggtgtgcccgaagtcttcggaatccccccggtcacgccaagtcagagagagttcgagcccagtccggggccccaagaatgtagcgccgaaagaagtccccgtgtagtccggcattggccgggtgggaaccgcctaaattttgagaaacccccctaggtgcggaacggggacgcctttgaggacgaccgggccaaccggggggctacaagagggaactgccccccccgtgttgagcgcgcgatcccgcggagaaagctttgttgcaaatatatcgaccacgtaagaggtgggtcccccctgtgtgcacaaaccgcccaatcttagcga

SEQ ID NO: 368969 - DNA, 1008 bp, Homo sapiens
agggctcccagacatcacctctgcccgccgccacctcctccaactctcccagctcagccggagccggagcgcgcaacaaccaagtccgagactggaggcagatcggggggaggggagaagcgccaagcgcgctgccctcccagggaaactcactgccgcctactcccagccggccacagtcaccagctcaaaatggcgacgacgagaagggagtcggcgctccgaccaccatccacctactaaggaagcgcgctctggccggccccggcgattggtcaccgcccgctaggggacagccctggcctcctctgattggcaagcgctggccacctccccacaccccttgcgaacgctcccctagtggagaaaaggagtagctattagccaattcggcagggcccgctttttagaagcttgatttcctttgaagatgaaagactagcggaagctctgcctctttccccagtgggcgagggaactcggggcgattggctgggaactgtatccacccaaatgtcaccgatttcttcctatgcaggaaatgagcagacccatcaataagaaatttctcagcctggccgaaaatggttggccccacgaagccacgacaactggaggcaaagagggttgctcaacgccccgcctcattggaaaaccaaatcagatctgggacctatatagcgtggcggaggcggggcgatgattgtcgcgctcgcacccactgcagctgcgcacagtcgcatttctttccccgcccctgagaccctgcagcaccatctgtcatggcggctgggctgtttggtttgagcgctcgccgtcttttggcggcagcggcgacgcgagggctcccggccgcccgcgtccgctgggaatctagcttctccaggactgtggtcgccccgtccgctgtggcgggaaagcggcccccagaaccgaccacaccgtggcaacgaaactgaaaaccctggaaggcggcgactttgcggtaccagctcaattctatatgta

SEQ ID NO: 368970 - DNA, 3499 bp, Homo sapiens
agcgggcagaacgctccagacgctgagaggcaggaggcactagggatcgtccgcaggattgggactgatacagaggccgccacggagcccgccggagccaccgttcctgctgctgccgccgctgcccgaatcggaaccgtcgggccgcagccgccggcaatgccgcgaaggaagaggaatgcaggcagtagttcagatggaaccgaagattccgatttttctacagatctcgagcacacagacagttcagaaagtgatggcacatcccgacgatctgctcgagtcacccgctcctcagccaggctaagccagagttctcaagattccagtcctgttcgaaatctgcagtcttttggcactgaggagcctgcttactctaccagaagagtgacccgtagtcagcagcagcctaccccagtgacaccgaaaaaataccctcttcggcagactcgttcatctggttcagaaactgagcaagtggttgatttttcagatagagaaactaaaaatacagctgatcatgatgagtcaccgcctcgaactccaactggaaatgcgccttcttctgagtctgacatagacatctccagccccaatgtatctcacgatgagagcattgccaaggacatgtccctgaaggactcaggcagtgatctctctcatcgccccaagcgccgtcgcttccatgaaagctacaacttcaatatgaagtgtcctacaccaggctgtaactctctaggacaccttacaggaaaacatgagagacatttctccatctcaggatgcccactgtatcataacctctcagctgacgaatgcaaggcaccaacggagaggcagcttcgatataaggaaaaagtggctgaactcaggaagaaaagaaattctggactgagcaaagaacagaaagagaaatatatggaacacagacagacctatgggaacacacgggaacctcttttagaaaacctgacaagcgagtatgacttggatcttttccgaagagcacaagcccgggcttcagaggatttggagaagttaaggctgcaaggccaaatcacagagggaagcaacatgattaaaacaattgcttttggccgctatgagcttgatacctggtatcattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtgtttgaagtggatggcaagaaaaacaagatctactgccaaaacctgtgcctgttggccaaactttttctggaccacaagacattatattatgatgtggagcccttcctgttctatgttatgacagaggcggacaacactggctgtcacctgattggatatttttctaaggaaaagaattcattcctcaactacaacgtctcctgtatccttactatgcctcagtacatgagacagggctatggcaagatgcttattgatttcagttatttgctttccaaagtcgaagaaaaagttggctccccagaacgtccactctcagatctggggcttataagctatcgcagttactggaaagaagtacttctccgctacctgcataattttcaaggcaaagagatttctatcaaagaaatcagtcaggagacggctgtgaatcctgtggacattgtcagcactctgcaagcccttcagatgctcaaatactggaagggaaaacacctagttttaaagagacaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtgaggttgcctggatgggatctgtattagacttgagtgcaggtctctcagcactgacccaaggagttctgttatggtactgtacctgtccagtcactggttctctcctcatgtcctctcgccccatgaggttgtgttgtgtcttctaagcgtggtactagtgcttgccacctggtcaccagacctccaaatatggctgccaccaccaggacctttccagttactccttatatgtgtgttctatggaggggcagggaaaaggtggcacttgtgagtgtgtgtggattggcagggggtccattcactttgggttccatcttgctttaaatttcttcattttgattaagagacctctttttgatctgtattgggctaaccagagccaaatacttttgaagagtttcccagggactagtcatggtaatagcatataattgatctgaatgagatggagagaagaatgaaggggtggtggttctgggtttgatttgagttcacctgtgggcagtgggcagtgggcagtgtcttggtgaaagggaacggatactactttttgcctcaccgtaaagtactcactagtaaatatttccttctctctttactcccactttttacgtttgcaggtgccaaagtaatgtccacttttccctttcatgctgcatattaactggttaattatactgcagaaaccttttcacctccactagtctgatacagtacatctgtacttccatataccttgcactgattttgtctgagtgccctgggagaagtagaaaatgattgaaagtgacttccgtatctcagcccatgactcagcaaggcagaatggccacccctgccaaagtttgcttctcttttcaacagtgcctcaccctccctctaggattaaagtgcttctgcccttccacgaactcctcctccatttcctttttgggatttgtcaccatccttctattctctggtcttctatttttggtgttgttcaagtgaaggaagagatgttccctctaatttctctctagcccattataacctgctatcttggggcaacttttgatgtatgacatgtcacccttcccaacttggtctcctccaacatgctgtcttcatgtggagccctcaccacaatccctgactccggtcatttgtgcctttctcttgtcatctctgtacactacttatattcactgtgggttgggggagctaattttaagcatgttcagtggcagctcccctccagtttcagtgtcactgttaaaatttatcaaaaagcaacttcactaggggttttcttaagggataaaggccttttacagaagctaaacccttccccacatgtggtagaatgtgctcttctatatctactcctcaataaagcatgttctctgctcaa

SEQ ID NO: 368971 - DNA, 4233 bp, Homo sapiens
agcgggcagaacgctccagacgctgagaggcaggaggcactagggatcgtccgcaggattgggactgatacagaggccgccacggagcccgccggagccaccgttcctgctgctgccgccgctgcccgaatcggaaccgtcgggccgcagccgccggcaatgccgcgaaggaagaggaatgcaggcagtagttcagatggaaccgaagattccgatttttctacagatctcgagcacacagacagttcagaaagtgatggcacatcccgacgatctgctcgagtcacccgctcctcagccaggctaagccagagttctcaagattccagtcctgttcgaaatctgcagtcttttggcactgaggagcctgcttactctaccagaagagtgacccgtagtcagcagcagcctaccccagtgacaccgaaaaaataccctcttcggcagactcgttcatctggttcagaaactgagcaagtggttgatttttcagatagagaaactaaaaatacagctgatcatgatgagtcaccgcctcgaactccaactggaaatgcgccttcttctgagtctgacatagacatctccagccccaatgtatctcacgatgagagcattgccaaggacatgtccctgaaggactcaggcagtgatctctctcatcgccccaagcgccgtcgcttccatgaaagctacaacttcaatatgaagtgtcctacaccaggctgtaactctctaggacaccttacaggaaaacatgagagacatttctccatctcaggatgcccactgtatcataacctctcagctgacgaatgcaaggtgagagcacagagccgggataagcagatagaagaaaggatgctgtctcacaggcaagatgacaacaacaggcatgcaaccaggcaccaggcaccaacggagaggcagcttcgatataaggaaaaagtggctgaactcaggaagaaaagaaattctggactgagcaaagaacagaaagagaaatatatggaacacagacagacctatgggaacacacgggaacctcttttagaaaacctgacaagcgagtatgacttggatcttttccgaagagcacaagcccgggcttcagaggatttggagaagttaaggctgcaaggccaaatcacagagggaagcaacatgattaaaacaattgcttttggccgctatgagcttgatacctggtatcattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtgtttgaagtggatggcaagaaaaacaagatctactgccaaaacctgtgcctgttggccaaactttttctggaccacaagacattatattatgatgtggagcccttcctgttctatgttatgacagaggcggacaacactggctgtcacctgattggatatttttctaaggaaaagaattcattcctcaactacaacgtctcctgtatccttactatgcctcagtacatgagacagggctatggcaagatgcttattgatttcagttatttgctttccaaagtcgaagaaaaagttggctccccagaacgtccactctcagatctggggcttataagctatcgcagttactggaaagaagtacttctccgctacctgcataattttcaaggcaaagagatttctatcaaagaaatcagtcaggagacggctgtgaatcctgtggacattgtcagcactctgcaagcccttcagatgctcaaatactggaagggaaaacacctagttttaaagagacaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtgaggttgcctggatgggatctgtattagacttgagtgcaggtctctcagcactgacccaaggagttctgttatggtactgtacctgtccagtcactggttctctcctcatgtcctctcgccccatgaggttgtgttgtgtcttctaagcgtggtactagtgcttgccacctggtcaccagacctccaaatatggctgccaccaccaggacctttccagttactccttatatgtgtgttctatggaggggcagggaaaaggtggcacttgtgagtgtgtgtggattggcagggggtccattcactttgggttccatcttgctttaaatttcttcattttgattaagagacctctttttgatctgtattgggctaaccagagccaaatacttttgaagagtttcccagggactagtcatggtaatagcatataattgatctgaatgagatggagagaagaatgaaggggtggtggttctgggtttgatttgagttcacctgtgggcagtgggcagtgggcagtgtcttggtgaaagggaacggatactactttttgcctcaccgtaaagtactcactagtaaatatttccttctctctttactcccactttttacgtttgcaggtgccaaagtaatgtccacttttccctttcatgctgcatattaactggttaattatactgcagaaaccttttcacctccactagtctgatacagtacatctgtacttccatataccttgcactgattttgtctgagtgccctgggagaagtagaaaatgattgaaagtgacttccgtatctcagcccatgactcagcaaggcagaatggccacccctgccaaagtttgcttctcttttcaacagtgcctcaccctccctctaggattaaagtgcttctgcccttccacgaactcctcctccatttcctttttgggatttgtcaccatccttctattctctggtcttctatttttggtgttgttcaagtgaaggaagagatgttccctctaatttctctctagcccattataacctgctatcttggggcaacttttgatgtatgacatgtcacccttcccaacttggtctcctccaacatgctgtcttcatgtggagccctcaccacaatccctgactccggtcatttgtgcctttctcttgtcatctctgtacactacttatattcactgtgggttgggggagctaattttaagcatgttcagtggcagctcccctccagtttcagtgtcactgttaaaatttatcaaaaagcaacttcactaggggttttcttaagggataaaggccttttacagaagctaaacccttccccacatgtggtagaatgtgctcttctatatctactcctcaataaagcatgttctctgctcaaaaaaaaaaaaaaaaaaaaaaaaaaaaaaaaaaaaaaaaaaaactcgagaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtact

SEQ ID NO: 368972 - DNA, 3246 bp, Homo sapiens
  misc_feature (1)..(1): n is a, c, g, or t
nccgagagaagacccctccacgttgtctctcctccccatcccattgttctctgttgatctccctcctgtttctccctttgctctctgtccctgttcctgttgtccctccccggtcaacggtccccatcttgttggttagccccccctagcctcgttctgtctttgtctatccccctggctcagccctcactcctggttcctgctctgcgggcccaactcggtcacatcgtggacccagtttttttcaggagccagctcatacccttggcatagaccggtttcattccacagcccctagagctcaacctcagcatggacaacaacagccctgggcaagtgaatcctgagaaaaagggtccctcttggcgcaagggcaagagggccatcacagtacaaaggagggaaggcccatctcagtaggaagtcccaggtagggagggcttcctcaacccatggacaccaggctcttggcacaaggcaaccccatctatagggtatgtacaagataccctctggttagagtagaaaggggagatgcctttcctggaacacagggtagggagattctagaaaaggttgtgttcaggaagaaagagaaaggccacagacccagcaaacagatagtcaagtcagaagagaagagagaacatctcaggacaaagctggaagaacacagacagacctatgggaacacacgggaacctcttttagaaaacctgacaagcgagtatgacttggatcttttccgaagagcacaagcccgggcttcagaggatttggagaagttaaggctgcaaggccaaatcacagagggaagcaacatgattaaaacaattgcttttggccgctatgagcttgatacctggtatcattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtgtttgaagtggatggcaagaaaaacaagatctactgccaaaacctgtgcctgttggccaaactttttctggaccacaagacattatattatgatgtggagcccttcctgttctatgttatgacagaggcggacaacactggctgtcacctgattggatatttttctaaggaaaagaattcattcctcaactacaacgtctcctgtatccttactatgcctcagtacatgagacagggctatggcaagatgcttattgatttcagttatttgctttccaaagtcgaagaaaaagttggctccccagaacgtccactctcagatctggggcttataagctatcgcagttactggaaagaagtacttctccgctacctgcataattttcaaggcaaagagatttctatcaaagaaatcagtcaggagacggctgtgaatcctgtggacattgtcagcactctgcaagcccttcagatgctcaaatactggaagggaaaacacctagttttaaagagacaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtgaggttgcctggatgggatctgtattagacttgagtgcaggtctctcagcactgacccaaggagttctgttatggtactgtacctgtccagtcactggttctctcctcatgtcctctcgccccatgaggttgtgttgtgtcttctaagcgtggtactagtgcttgccacctggtcaccagacctccaaatatggctgccaccaccaggacctttccagttactccttatatgtgtgttctatggaggggcagggaaaaggtggcacttgtgagtgtgtgtggattggcagggggtccattcactttgggttccatcttgctttaaatttcttcattttgattaagagacctctttttgatctgtattgggctaaccagagccaaatacttttgaagagtttcccagggactagtcatggtaatagcatataattgatctgaatgagatggagagaagaatgaaggggtggtggttctgggtttgatttgagttcacctgtgggcagtgggcagtgggcagtgtcttggtgaaagggaacggatactactttttgcctcaccgtaaagtactcactagtaaatatttccttctctctttactcccactttttacgtttgcaggtgccaaagtaatgtccacttttccctttcatgctgcatattaactggttaattatactgcagaaaccttttcacctccactagtctgatacagtacatctgtacttccatataccttgcactgattttgtctgagtgccctgggagaagtagaaaatgattgaaagtgacttccgtatctcagcccatgactcagcaaggcagaatggccacccctgccaaagtttgcttctcttttcaacagtgcctcaccctccctctaggattaaagtgcttctgcccttccacgaactcctcctccatttcctttttgggatttgtcaccatccttctattctctggtcttctatttttggtgttgttcaagtgaaggaagagatgttccctctaatttctctctagcccattataacctgctatcttggggcaacttttgatgtatgacatgtcacccttcccaacttggtctcctccaacatgctgtcttcatgtggagccctcaccacaatccctgactccggtcatttgtgcctttctcttgtcatctctgtacactacttatattcactgtgggttgggggagctaattttaagcatgttcagtggcagctcccctccagtttcagtgtcactgttaaaatttatcaaaaagcaacttcactaggggttttcttaagggataaaggccttttacagaagctaaacccttccccacatgtggtagaatgtgctcttctatatctactcctcaataaagcatgttctctgctcaa

SEQ ID NO: 368973 - DNA, 2641 bp, Homo sapiens
cggggagtatctaccaaagctccttccaaatctcaggattctgggaatttgtagtgtctctgggaacacagacagacctatgggaacacacgggaacctcttttagaaaacctgacaagcgagtatgacttggatcttttccgaagagcacaagcccgggcttcagaggatttggagaagttaaggctgcaaggccaaatcacagagggaagcaacatgattaaaacaattgcttttggccgctatgagcttgatacctggtatcattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtgtttgaagtggatggcaagaaaaacaagatctactgccaaaacctgtgcctgttggccaaactttttctggaccacaagacattatattatgatgtggagcccttcctgttctatgttatgacagaggcggacaacactggctgtcacctgattggatatttttctaaggaaaagaattcattcctcaactacaacgtctcctgtatccttactatgcctcagtacatgagacagggctatggcaagatgcttattgatttcagttatttgctttccaaagtcgaagaaaaagttggctccccagaacgtccactctcagatctggggcttataagctatcgcagttactggaaagaagtacttctccgctacctgcataattttcaaggcaaagagatttctatcaaagaaatcagtcaggagacggctgtgaatcctgtggacattgtcagcactctgcaagcccttcagatgctcaaatactggaagggaaaacacctagttttaaagagacaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtgaggttgcctggatgggatctgtattagacttgagtgcaggtctctcagcactgacccaaggagttctgttatggtactgtacctgtccagtcactggttctctcctcatgtcctctcgccccatgaggttgtgttgtgtcttctaagcgtggtactagtgcttgccacctggtcaccagacctccaaatatggctgccaccaccaggacctttccagttactccttatatgtgtgttctatggaggggcagggaaaaggtggcacttgtgagtgtgtgtggattggcagggggtccattcactttgggttccatcttgctttaaatttcttcattttgattaagagacctctttttgatctgtattgggctaaccagagccaaatacttttgaagagtttcccagggactagtcatggtaatagcatataattgatctgaatgagatggagagaagaatgaaggggtggtggttctgggtttgatttgagttcacctgtgggcagtgggcagtgggcagtgtcttggtgaaagggaacggatactactttttgcctcaccgtaaagtactcactagtaaatatttccttctctctttactcccactttttacgtttgcaggtgccaaagtaatgtccacttttccctttcatgctgcatattaactggttaattatactgcagaaaccttttcacctccactagtctgatacagtacatctgtacttccatataccttgcactgattttgtctgagtgccctgggagaagtagaaaatgattgaaagtgacttccgtatctcagcccatgactcagcaaggcagaatggccacccctgccaaagtttgcttctcttttcaacagtgcctcaccctccctctaggattaaagtgcttctgcccttccacgaactcctcctccatttcctttttgggatttgtcaccatccttctattctctggtcttctatttttggtgttgttcaagtgaaggaagagatgttccctctaatttctctctagcccattataacctgctatcttggggcaacttttgatgtatgacatgtcacccttcccaacttggtctcctccaacatgctgtcttcatgtggagccctcaccacaatccctgactccggtcatttgtgcctttctcttgtcatctctgtacactacttatattcactgtgggttgggggagctaattttaagcatgttcagtggcagctcccctccagtttcagtgtcactgttaaaatttatcaaaaagcaacttcactaggggttttcttaagggataaaggccttttacagaagctaaacccttccccacatgtggtagaatgtgctcttctatatctactcctcaataaagcatgttctctgctcaa

SEQ ID NO: 368974 - DNA, 2040 bp, Homo sapiens
aacaaaaactatacggctaaggtacgaggccgggtgtgtatatgcctcagtacatgagacagggctatggcaagatgcttattgatttcagttatttgctttccaaagtcgaagaaaaagttggctccccagaacgtccactctcagatctggggcttataagctatcgcagttactggaaagaagtacttctccgctacctgcataattttcaaggcaaagagatttctatcaaagaaatcagtcaggagacggctgtgaatcctgtggacattgtcagcactctgcaagcccttcagatgctcaaatactggaagggaaaacacctagttttaaagagacaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtgaggttgcctggatgggatctgtattagacttgagtgcaggtctctcagcactgacccaaggagttctgttatggtactgtacctgtccagtcactggttctctcctcatgtcctctcgccccatgaggttgtgttgtgtcttctaagcgtggtactagtgcttgccacctggtcaccagacctccaaatatggctgccaccaccaggacctttccagttactccttatatgtgtgttctatggaggggcagggaaaaggtggcacttgtgagtgtgtgtggattggcagggggtccattcactttgggttccatcttgctttaaatttcttcattttgattaagagacctctttttgatctgtattgggctaaccagagccaaatacttttgaagagtttcccagggactagtcatggtaatagcatataattgatctgaatgagatggagagaagaatgaaggggtggtggttctgggtttgatttgagttcacctgtgggcagtgggcagtgggcagtgtcttggtgaaagggaacggatactactttttgcctcaccgtaaagtactcactagtaaatatttccttctctctttactcccactttttacgtttgcaggtgccaaagtaatgtccacttttccctttcatgctgcatattaactggttaattatactgcagaaaccttttcacctccactagtctgatacagtacatctgtacttccatataccttgcactgattttgtctgagtgccctgggagaagtagaaaatgattgaaagtgacttccgtatctcagcccatgactcagcaaggcagaatggccacccctgccaaagtttgcttctcttttcaacagtgcctcaccctccctctaggattaaagtgcttctgcccttccacgaactcctcctccatttcctttttgggatttgtcaccatccttctattctctggtcttctatttttggtgttgttcaagtgaaggaagagatgttccctctaatttctctctagcccattataacctgctatcttggggcaacttttgatgtatgacatgtcacccttcccaacttggtctcctccaacatgctgtcttcatgtggagccctcaccacaatccctgactccggtcatttgtgcctttctcttgtcatctctgtacactacttatattcactgtgggttgggggagctaattttaagcatgttcagtggcagctcccctccagtttcagtgtcactgttaaaatttatcaaaaagcaacttcactaggggttttcttaagggataaaggccttttacagaagctaaacccttccccacatgtggtagaatgtgctcttctatatctactcctcaataaagcatgttctctgctcaa

SEQ ID NO: 368975 - DNA, 2208 bp, Homo sapiens
acgagtagctgggattacaggcatgtgccaccacgcccagctaattttgtatttttttagtggagacggagtttctccatgttggtcaggctggtctcgaactcccgagctcaggtgatccgcccacctcagcctcccagagtgctggaattacaggcgtgagccaccttgcccggccaccttctttcatttttaagtcacctgagaagagatgaactgggaagtgacataagaggggaactatatatctttgaataggttatttgctttccaaagtcgaagaaaaagttggctccccagaacgtccactctcagatctggggcttataagctatcgcagttactggaaagaagtacttctccgctacctgcataattttcaaggcaaagagatttctatcaaagaaatcagtcaggagacggctgtgaatcctgtggacattgtcagcactctgcaagcccttcagatgctcaaatactggaagggaaaacacctagttttaaagagacaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtgaggttgcctggatgggatctgtattagacttgagtgcaggtctctcagcactgacccaaggagttctgttatggtactgtacctgtccagtcactggttctctcctcatgtcctctcgccccatgaggttgtgttgtgtcttctaagcgtggtactagtgcttgccacctggtcaccagacctccaaatatggctgccaccaccaggacctttccagttactccttatatgtgtgttctatggaggggcagggaaaaggtggcacttgtgagtgtgtgtggattggcagggggtccattcactttgggttccatcttgctttaaatttcttcattttgattaagagacctctttttgatctgtattgggctaaccagagccaaatacttttgaagagtttcccagggactagtcatggtaatagcatataattgatctgaatgagatggagagaagaatgaaggggtggtggttctgggtttgatttgagttcacctgtgggcagtgggcagtgggcagtgtcttggtgaaagggaacggatactactttttgcctcaccgtaaagtactcactagtaaatatttccttctctctttactcccactttttacgtttgcaggtgccaaagtaatgtccacttttccctttcatgctgcatattaactggttaattatactgcagaaaccttttcacctccactagtctgatacagtacatctgtacttccatataccttgcactgattttgtctgagtgccctgggagaagtagaaaatgattgaaagtgacttccgtatctcagcccatgactcagcaaggcagaatggccacccctgccaaagtttgcttctcttttcaacagtgcctcaccctccctctaggattaaagtgcttctgcccttccacgaactcctcctccatttcctttttgggatttgtcaccatccttctattctctggtcttctatttttggtgttgttcaagtgaaggaagagatgttccctctaatttctctctagcccattataacctgctatcttggggcaacttttgatgtatgacatgtcacccttcccaacttggtctcctccaacatgctgtcttcatgtggagccctcaccacaatccctgactccggtcatttgtgcctttctcttgtcatctctgtacactacttatattcactgtgggttgggggagctaattttaagcatgttcagtggcagctcccctccagtttcagtgtcactgttaaaatttatcaaaaagcaacttcactaggggttttcttaagggataaaggccttttacagaagctaaacccttccccacatgtggtagaatgtgctcttctatatctactcctcaataaagcatgttctctgctcaa

SEQ ID NO: 368976 - DNA, 1681 bp, Homo sapiens
agcgggcagaacgctccagacgctgagaggcaggaggcactagggatcgtccgcaggattgggactgatacagaggccgccacggagcccgccggagccaccgttcctgctgctgccgccgctgcccgaatcggaaccgtcgggccgcagccgccggcaatgccgcgaaggaagaggaatgcaggcagtagttcagatggaaccgaagattccgatttttctacagatctcgagcacacagacagttcagaaagtgatggcacatcccgacgatctgctcgagtcacccgctcctcagccaggctaagccagagttctcaagattccagtcctgttcgaaatctgcagtcttttggcactgaggagcctgcttactctaccagaagagtgacccgtagtcagcagcagcctaccccagtgacaccgaaaaaataccctcttcggcagactcgttcatctggttcagaaactgagcaagtggttgatttttcagatagagaaactaaaaatacagctgatcatgatgagtcaccgcctcgaactccaactggaaatgcgccttcttctgagtctgacatagacatctccagccccaatgtatctcacgatgagagcattgccaaggacatgtccctgaaggactcaggcagtgatctctctcatcgccccaagcgccgtcgcttccatgaaagctacaacttcaatatgaagtgtcctacaccaggctgtaactctctaggacaccttacaggaaaacatgagagacatttctccatctcaggatgcccactgtatcataacctctcagctgacgaatgcaaggtgagagcacagagccgggataagcagatagaagaaaggatgctgtctcacaggcaagatgacaacaacaggcatgcaaccaggcaccaggcaccaacggagaggcagcttcgatataaggaaaaagtggctgaactcaggaagaaaagaaattctggactgagcaaagaacagaaagagaaatatatggaacacagacagacctatgggaacacacgggaacctcttttagaaaacctgacaagcgagtatgacttggatcttttccgaagagcacaagcccgggcttcagaggatttggagaagttaaggctgcaaggccaaatcacagagggaagcaacatgattaaaacaattgcttttggccgctatgagcttgatacctggtatcattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtgtttgaagtggatggcaagaaaaacaagatctactgccaaaacctgtgcctgttggccaaactttttctggaccacaagacattatattatgatgtggagcccttcctgttctatgttatgacagaggcggacaacactggctgtcacctgattggatatttttctaaggtaagcaggatctggagattaagaagccaatggccagagcagggtgatccatgttcgcagttgggggctcaaatcactgacaggaagaagctgtactctgggcaatgatgacaccccttccttaaattaaaaaaaa

SEQ ID NO: 368977 - DNA, 1598 bp, Homo sapiens
agcgggcagaacgctccagacgctgagaggcaggaggcactagggatcgtccgcaggattgggactgatacagaggccgccacggagcccgccggagccaccgttcctgctgctgccgccgctgcccgaatcggaaccgtcgggccgcagccgccggcaatgccgcgaaggaagaggaatgcaggcagtagttcagatggaaccgaagattccgatttttctacagatctcgagcacacagacagttcagaaagtgatggcacatcccgacgatctgctcgagtcacccgctcctcagccaggctaagccagagttctcaagattccagtcctgttcgaaatctgcagtcttttggcactgaggagcctgcttactctaccagaagagtgacccgtagtcagcagcagcctaccccagtgacaccgaaaaaataccctcttcggcagactcgttcatctggttcagaaactgagcaagtggttgatttttcagatagagaaactaaaaatacagctgatcatgatgagtcaccgcctcgaactccaactggaaatgcgccttcttctgagtctgacatagacatctccagccccaatgtatctcacgatgagagcattgccaaggacatgtccctgaaggactcaggcagtgatctctctcatcgccccaagcgccgtcgcttccatgaaagctacaacttcaatatgaagtgtcctacaccaggctgtaactctctaggacaccttacaggaaaacatgagagacatttctccatctcaggatgcccactgtatcataacctctcagctgacgaatgcaaggtgagagcacagagccgggataagcagatagaagaaaggatgctgtctcacaggcaagatgacaacaacaggcatgcaaccaggcaccaggcaccaacggagaggcagcttcgatataaggaaaaagtggctgaactcaggaagaaaagaaattctggactgagcaaagaacagaaagagaaatatatggaacacagacagacctatgggaacacacgggaacctcttttagaaaacctgacaagcgagtatgacttggatcttttccgaagagcacaagcccgggcttcagaggatttggagaagttaaggctgcaaggccaaatcacagagggaagcaacatgattaaaacaattgcttttggccgctatgagcttgatacctggtatcattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtacactacttatattcactgtgggttgggggagctaattttaagcatgttcagtggcagctcccctccagtttcagtgtcactgttaaaatttatcaaaaagcaacttcactaggggttttcttaagggataaaggccttttacagaagctaaacccttccccacatgtggtagaatgtgctcttctatatctactcctcaataaagcatgttctctgctcaa

SEQ ID NO: 368978 - DNA, 385 bp, Homo sapiens
actcaaactcacatctaattttttaaattatttcatatatacaataaaggtcggtgagcgatgattttcatttctcactgagggtaaagtaggaagaatggattagataggaaagcagtttataagtcaaaatatagtattttttttgataccctaatatgttgttaaacctttggcaattccttcttggcggttagttattttggaatctatgtaaaggcacttgagttgaaagtatgtaatcctttttcccattgttctccctcaggacctgattgatgagtggatagccaaagaggccaaaaggtccaactccaataaaaccatggatcccagctgcttaaaatggacccctcccaagggcacttaaagtgacctgtcattc

SEQ ID NO: 368979 - DNA, 386 bp, Homo sapiens
cttgcccaagatgccacagctagttggtatggtggagtggagttgaatcaagttcagtcctaattccagaacctaaacttattaatgctgtactacattacatctgtatacctgagctaggctcttttgcttatattttatttaattaaatagatattttaaggatttgttggattttgtgaaatatgaagaggaggaggagcgatattctgataaattatatggataggaagtaaaacagatttccatcttttttctttattttcttttaaaattgggatcagattccagtcctgttcgaaatctgcagtcttttggcactgaggagcctgcttactctaccagaagagtgacccgtagtcagcagcagcctaccccagtgacac

SEQ ID NO: 368980 - DNA, 807 bp, Homo sapiens
tacaaagtttcttttacaaaacatccctccgcaactttgagtttatataataaacggaaacgtcctttaaacaatcaggctacgaaggggttaaatctaatctcagcaacctgatggattctggggggtttccttcctcgactctagaaattaaaacgaaattttgcccaaggtaaagatgagaaccgtttacatcaactgtcaggcttctgccccaaacaagaatggctacccacgcccacaaacagagccactcacgtaactaaaaatggttggctccgggttccaccactggagtcactttctgcccaacttcaaaatggcgcccactagcttcaccaaaaggatcgaacttcccagcaccctctctggcccgtaacgtcaggtgacgcgagacccagccggaagtgaaggaaaaagcgcttcagcccgcggcgccagcgggcagaacgctccagacgctgagaggcaggaggcactagggatcgtccgcaggattgggactgatacagaggccgccacggagcccgccggagccaccgttcctgctgctgccgccgctgcccgaatcggaaccgtcgggccgcagccgccggcaatgccgcgaaggaaggtgagaaacgggagaggagggatggcgggtttctaaggacagtcgattgagcaccgtgacgcagttggccacgcctcacagtgcttgggtcccaactttccgctcccccgaaccttgttcagctaccctctcttctgtccatacccaacagaaaaatgtgggcccgaccctggcctcggcctatgcttgcaact

SEQ ID NO: 368981 - DNA, 3589 bp, Homo sapiens
agcgggcagaacgctccagacgctgagaggcaggaggcactagggatcgtccgcaggattgggactgatacagaggccgccacggagcccgccggagccaccgttcctgctgctgccgccgctgcccgaatcggaaccgtcgggccgcagccgccggcaatgccgcgaaggaagaggaatgcaggcagtagttcagatggaaccgaagattccgatttttctacagatctcgagcacacagacagttcagaaagtgatggcacatcccgacgatctgctcgagtcacccgctcctcagccaggctaagccagagttctcaagattccagtcctgttcgaaatctgcagtcttttggcactgaggagcctgcttactctaccagaagagtgacccgtagtcagcagcagcctaccccagtgacaccgaaaaaataccctcttcggcagactcgttcatctggttcagaaactgagcaagtggttgatttttcagatagagaaactaaaaatacagctgatcatgatgagtcaccgcctcgaactccaactggaaatgcgccttcttctgagtctgacatagacatctccagccccaatgtatctcacgatgagagcattgccaaggacatgtccctgaaggactcaggcagtgatctctctcatcgccccaagcgccgtcgcttccatgaaagctacaacttcaatatgaagtgtcctacaccaggctgtaactctctaggacaccttacaggaaaacatgagagacatttctccatctcaggatgcccactgtatcataacctctcagctgacgaatgcaaggtgagagcacagagccgggataagcagatagaagaaaggatgctgtctcacaggcaagatgacaacaacaggcatgcaaccaggcaccaggcaccaacggagaggcagcttcgatataaggaaaaagtggctgaactcaggaagaaaagaaattctggactgagcaaagaacagaaagagaaatatatggaacacagacagacctatgggaacacacgggaacctcttttagaaaacctgacaagcgagtatgacttggatcttttccgaagagcacaagcccgggcttcagaggatttggagaagttaaggctgcaaggccaaatcacagagggaagcaacatgattaaaacaattgcttttggccgctatgagcttgatacctggtatcattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtgtttgaagtggatggcaagaaaaacaagatctactgccaaaacctgtgcctgttggccaaactttttctggaccacaagacattatattatgatgtggagcccttcctgttctatgttatgacagaggcggacaacactggctgtcacctgattggatatttttctaaggaaaagaattcattcctcaactacaacgtctcctgtatccttactatgcctcagtacatgagacagggctatggcaagatgcttattgatttcagttatttgctttccaaagtcgaagaaaaagttggctccccagaacgtccactctcagatctggggcttataagctatcgcagttactggaaagaagtacttctccgctacctgcataattttcaaggcaaagagatttctatcaaagaaatcagtcaggagacggctgtgaatcctgtggacattgtcagcactctgcaagcccttcagatgctcaaatactggaagggaaaacacctagttttaaagagacaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtgaggttgcctggatgggatctgtattagacttgagtgcaggtctctcagcactgacccaaggagttctgttatggtactgtacctgtccagtcactggttctctcctcatgtcctctcgccccatgaggttgtgttgtgtcttctaagcgtggtactagtgcttgccacctggtcaccagacctccaaatatggctgccaccaccaggacctttccagttactccttatatgtgtgttctatggaggggcagggaaaaggtggcacttgtgagtgtgtgtggattggcagggggtccattcactttgggttccatcttgctttaaatttcttcattttgattaagagacctctttttgatctgtattgggctaaccagagccaaatacttttgaagagtttcccagggactagtcatggtaatagcatataattgatctgaatgagatggagagaagaatgaaggggtggtggttctgggtttgatttgagttcacctgtgggcagtgggcagtgggcagtgtcttggtgaaagggaacggatactactttttgcctcaccgtaaagtactcactagtaaatatttccttctctctttactcccactttttacgtttgcaggtgccaaagtaatgtccacttttccctttcatgctgcatattaactggttaattatactgcagaaaccttttcacctccactagtctgatacagtacatctgtacttccatataccttgcactgattttgtctgagtgccctgggagaagtagaaaatgattgaaagtgacttccgtatctcagcccatgactcagcaaggcagaatggccacccctgccaaagtttgcttctcttttcaacagtgcctcaccctccctctaggattaaagtgcttctgcccttccacgaactcctcctccatttcctttttgggatttgtcaccatccttctattctctggtcttctatttttggtgttgttcaagtgaaggaagagatgttccctctaatttctctctagcccattataacctgctatcttggggcaacttttgatgtatgacatgtcacccttcccaacttggtctcctccaacatgctgtcttcatgtggagccctcaccacaatccctgactccggtcatttgtgcctttctcttgtcatctctgtacactacttatattcactgtgggttgggggagctaattttaagcatgttcagtggcagctcccctccagtttcagtgtcactgttaaaatttatcaaaaagcaacttcactaggggttttcttaagggataaaggccttttacagaagctaaacccttccccacatgtggtagaatgtgctcttctatatctactcctcaataaagcatgttctctgctcaa

SEQ ID NO: 368982 - DNA, 4143 bp, Homo sapiens
agcgggcagaacgctccagacgctgagaggcaggaggcactagggatcgtccgcaggattgggactgatacagaggccgccacggagcccgccggagccaccgttcctgctgctgccgccgctgcccgaatcggaaccgtcgggccgcagccgccggcaatgccgcgaaggaagaggaatgcaggcagtagttcagatggaaccgaagattccgatttttctacagatctcgagcacacagacagttcagaaagtgatggcacatcccgacgatctgctcgagtcacccgctcctcagccaggctaagccagagttctcaagattccagtcctgttcgaaatctgcagtcttttggcactgaggagcctgcttactctaccagaagagtgacccgtagtcagcagcagcctaccccagtgacaccgaaaaaataccctcttcggcagactcgttcatctggttcagaaactgagcaagtggttgatttttcagatagagaaactaaaaatacagctgatcatgatgagtcaccgcctcgaactccaactggaaatgcgccttcttctgagtctgacatagacatctccagccccaatgtatctcacgatgagagcattgccaaggacatgtccctgaaggactcaggcagtgatctctctcatcgccccaagcgccgtcgcttccatgaaagctacaacttcaatatgaagtgtcctacaccaggctgtaactctctaggacaccttacaggaaaacatgagagacatttctccatctcaggatgcccactgtatcataacctctcagctgacgaatgcaaggcaccaacggagaggcagcttcgatataaggaaaaagtggctgaactcaggaagaaaagaaattctggactgagcaaagaacagaaagagaaatatatggaacacagacagacctatgggaacacacgggaacctcttttagaaaacctgacaagcgagtatgacttggatcttttccgaagagcacaagcccgggcttcagaggatttggagaagttaaggctgcaaggccaaatcacagagggaagcaacatgattaaaacaattgcttttggccgctatgagcttgatacctggtatcattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtgtttgaagtggatggcaagaaaaacaagatctactgccaaaacctgtgcctgttggccaaactttttctggaccacaagacattatattatgatgtggagcccttcctgttctatgttatgacagaggcggacaacactggctgtcacctgattggatatttttctaaggaaaagaattcattcctcaactacaacgtctcctgtatccttactatgcctcagtacatgagacagggctatggcaagatgcttattgatttcagttatttgctttccaaagtcgaagaaaaagttggctccccagaacgtccactctcagatctggggcttataagctatcgcagttactggaaagaagtacttctccgctacctgcataattttcaaggcaaagagatttctatcaaagaaatcagtcaggagacggctgtgaatcctgtggacattgtcagcactctgcaagcccttcagatgctcaaatactggaagggaaaacacctagttttaaagagacaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtgaggttgcctggatgggatctgtattagacttgagtgcaggtctctcagcactgacccaaggagttctgttatggtactgtacctgtccagtcactggttctctcctcatgtcctctcgccccatgaggttgtgttgtgtcttctaagcgtggtactagtgcttgccacctggtcaccagacctccaaatatggctgccaccaccaggacctttccagttactccttatatgtgtgttctatggaggggcagggaaaaggtggcacttgtgagtgtgtgtggattggcagggggtccattcactttgggttccatcttgctttaaatttcttcattttgattaagagacctctttttgatctgtattgggctaaccagagccaaatacttttgaagagtttcccagggactagtcatggtaatagcatataattgatctgaatgagatggagagaagaatgaaggggtggtggttctgggtttgatttgagttcacctgtgggcagtgggcagtgggcagtgtcttggtgaaagggaacggatactactttttgcctcaccgtaaagtactcactagtaaatatttccttctctctttactcccactttttacgtttgcaggtgccaaagtaatgtccacttttccctttcatgctgcatattaactggttaattatactgcagaaaccttttcacctccactagtctgatacagtacatctgtacttccatataccttgcactgattttgtctgagtgccctgggagaagtagaaaatgattgaaagtgacttccgtatctcagcccatgactcagcaaggcagaatggccacccctgccaaagtttgcttctcttttcaacagtgcctcaccctccctctaggattaaagtgcttctgcccttccacgaactcctcctccatttcctttttgggatttgtcaccatccttctattctctggtcttctatttttggtgttgttcaagtgaaggaagagatgttccctctaatttctctctagcccattataacctgctatcttggggcaacttttgatgtatgacatgtcacccttcccaacttggtctcctccaacatgctgtcttcatgtggagccctcaccacaatccctgactccggtcatttgtgcctttctcttgtcatctctgtacactacttatattcactgtgggttgggggagctaattttaagcatgttcagtggcagctcccctccagtttcagtgtcactgttaaaatttatcaaaaagcaacttcactaggggttttcttaagggataaaggccttttacagaagctaaacccttccccacatgtggtagaatgtgctcttctatatctactcctcaataaagcatgttctctgctcaaaaaaaaaaaaaaaaaaaaaaaaaaaaaaaaaaaaaaaaaaaactcgagaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtact

SEQ ID NO: 368983 - DNA, 2608 bp, Homo sapiens
ctggaaaggattcttgtagtgactgccatggaacacagacagacctatgggaacacacgggaacctcttttagaaaacctgacaagcgagtatgacttggatcttttccgaagagcacaagcccgggcttcagaggatttggagaagttaaggctgcaaggccaaatcacagagggaagcaacatgattaaaacaattgcttttggccgctatgagcttgatacctggtatcattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtgtttgaagtggatggcaagaaaaacaagatctactgccaaaacctgtgcctgttggccaaactttttctggaccacaagacattatattatgatgtggagcccttcctgttctatgttatgacagaggcggacaacactggctgtcacctgattggatatttttctaaggaaaagaattcattcctcaactacaacgtctcctgtatccttactatgcctcagtacatgagacagggctatggcaagatgcttattgatttcagttatttgctttccaaagtcgaagaaaaagttggctccccagaacgtccactctcagatctggggcttataagctatcgcagttactggaaagaagtacttctccgctacctgcataattttcaaggcaaagagatttctatcaaagaaatcagtcaggagacggctgtgaatcctgtggacattgtcagcactctgcaagcccttcagatgctcaaatactggaagggaaaacacctagttttaaagagacaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtgaggttgcctggatgggatctgtattagacttgagtgcaggtctctcagcactgacccaaggagttctgttatggtactgtacctgtccagtcactggttctctcctcatgtcctctcgccccatgaggttgtgttgtgtcttctaagcgtggtactagtgcttgccacctggtcaccagacctccaaatatggctgccaccaccaggacctttccagttactccttatatgtgtgttctatggaggggcagggaaaaggtggcacttgtgagtgtgtgtggattggcagggggtccattcactttgggttccatcttgctttaaatttcttcattttgattaagagacctctttttgatctgtattgggctaaccagagccaaatacttttgaagagtttcccagggactagtcatggtaatagcatataattgatctgaatgagatggagagaagaatgaaggggtggtggttctgggtttgatttgagttcacctgtgggcagtgggcagtgggcagtgtcttggtgaaagggaacggatactactttttgcctcaccgtaaagtactcactagtaaatatttccttctctctttactcccactttttacgtttgcaggtgccaaagtaatgtccacttttccctttcatgctgcatattaactggttaattatactgcagaaaccttttcacctccactagtctgatacagtacatctgtacttccatataccttgcactgattttgtctgagtgccctgggagaagtagaaaatgattgaaagtgacttccgtatctcagcccatgactcagcaaggcagaatggccacccctgccaaagtttgcttctcttttcaacagtgcctcaccctccctctaggattaaagtgcttctgcccttccacgaactcctcctccatttcctttttgggatttgtcaccatccttctattctctggtcttctatttttggtgttgttcaagtgaaggaagagatgttccctctaatttctctctagcccattataacctgctatcttggggcaacttttgatgtatgacatgtcacccttcccaacttggtctcctccaacatgctgtcttcatgtggagccctcaccacaatccctgactccggtcatttgtgcctttctcttgtcatctctgtacactacttatattcactgtgggttgggggagctaattttaagcatgttcagtggcagctcccctccagtttcagtgtcactgttaaaatttatcaaaaagcaacttcactaggggttttcttaagggataaaggccttttacagaagctaaacccttccccacatgtggtagaatgtgctcttctatatctactcctcaataaagcatgttctctgctcaa

SEQ ID NO: 368984 - DNA, 2119 bp, Homo sapiens
  misc_feature (12)..(12): n is a, c, g, or t
  misc_feature (20)..(20): n is a, c, g, or t
actaagctcggncctcactncatgtcacaagaggcggacaacactggctgtcacctgattggatatttttctaaggaaaagaattcattcctcaactacaacgtctcctgtatccttactatgcctcagtacatgagacagggctatggcaagatgcttattgatttcagttatttgctttccaaagtcgaagaaaaagttggctccccagaacgtccactctcagatctggggcttataagctatcgcagttactggaaagaagtacttctccgctacctgcataattttcaaggcaaagagatttctatcaaagaaatcagtcaggagacggctgtgaatcctgtggacattgtcagcactctgcaagcccttcagatgctcaaatactggaagggaaaacacctagttttaaagagacaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtgaggttgcctggatgggatctgtattagacttgagtgcaggtctctcagcactgacccaaggagttctgttatggtactgtacctgtccagtcactggttctctcctcatgtcctctcgccccatgaggttgtgttgtgtcttctaagcgtggtactagtgcttgccacctggtcaccagacctccaaatatggctgccaccaccaggacctttccagttactccttatatgtgtgttctatggaggggcagggaaaaggtggcacttgtgagtgtgtgtggattggcagggggtccattcactttgggttccatcttgctttaaatttcttcattttgattaagagacctctttttgatctgtattgggctaaccagagccaaatacttttgaagagtttcccagggactagtcatggtaatagcatataattgatctgaatgagatggagagaagaatgaaggggtggtggttctgggtttgatttgagttcacctgtgggcagtgggcagtgggcagtgtcttggtgaaagggaacggatactactttttgcctcaccgtaaagtactcactagtaaatatttccttctctctttactcccactttttacgtttgcaggtgccaaagtaatgtccacttttccctttcatgctgcatattaactggttaattatactgcagaaaccttttcacctccactagtctgatacagtacatctgtacttccatataccttgcactgattttgtctgagtgccctgggagaagtagaaaatgattgaaagtgacttccgtatctcagcccatgactcagcaaggcagaatggccacccctgccaaagtttgcttctcttttcaacagtgcctcaccctccctctaggattaaagtgcttctgcccttccacgaactcctcctccatttcctttttgggatttgtcaccatccttctattctctggtcttctatttttggtgttgttcaagtgaaggaagagatgttccctctaatttctctctagcccattataacctgctatcttggggcaacttttgatgtatgacatgtcacccttcccaacttggtctcctccaacatgctgtcttcatgtggagccctcaccacaatccctgactccggtcatttgtgcctttctcttgtcatctctgtacactacttatattcactgtgggttgggggagctaattttaagcatgttcagtggcagctcccctccagtttcagtgtcactgttaaaatttatcaaaaagcaacttcactaggggttttcttaagggataaaggccttttacagaagctaaacccttccccacatgtggtagaatgtgctcttctatatctactcctcaataaagcatgttctctgctcaa

SEQ ID NO: 368985 - DNA, 1904 bp, Homo sapiens
agcgggcagaacgctccagacgctgagaggcaggaggcactagggatcgtccgcaggattgggactgatacagaggccgccacggagcccgccggagccaccgttcctgctgctgccgccgctgcccgaatcggaaccgtcgggccgcagccgccggcaatgccgcgaaggaagaggaatgcaggcagtagttcagatggaaccgaagattccgatttttctacagatctcgagcacacagacagttcagaaagtgatggcacatcccgacgatctgctcgagtcacccgctcctcagccaggctaagccagagttctcaagattccagtcctgttcgaaatctgcagtcttttggcactgaggagcctgcttactctaccagaagagtgacccgtagtcagcagcagcctaccccagtgacaccgaaaaaataccctcttcggcagactcgttcatctggttcagaaactgagcaagtggttgatttttcagatagagaaactaaaaatacagctgatcatgatgagtcaccgcctcgaactccaactggaaatgcgccttcttctgagtctgacatagacatctccagccccaatgtatctcacgatgagagcattgccaaggacatgtccctgaaggactcaggcagtgatctctctcatcgccccaagcgccgtcgcttccatgaaagctacaacttcaatatgaagtgtcctacaccaggctgtaactctctaggacaccttacaggaaaacatgagagacatttctccatctcaggatgcccactgtatcataacctctcagctgacgaatgcaaggtgagagcacagagccgggataagcagatagaagaaaggatgctgtctcacaggcaagatgacaacaacaggcatgcaaccaggcaccaggcaccaacggagaggcagcttcgatataaggaaaaagtggctgaactcaggaagaaaagaaattctggactgagcaaagaacagaaagagaaatatatggaacacagacagacctatgggaacacacgggaacctcttttagaaaacctgacaagcgagtatgacttggatcttttccgaagagcacaagcccgggcttcagaggatttggagaagttaaggctgcaaggccaaatcacagagggaagcaacatgattaaaacaattgcttttggccgctatgagcttgatacctggtatcattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtgtttgaagtggatggcaagaaaaacaaggtaaaaagtggtgactttagaaaggagttgaaatgttgtatattcacaggtttcagaaggcatatgttttttctccatcacaccttgtgaaggacatagaactcttctcttgccaaaatacacaatgtgtttcattaataattatggtatgtttgtgaattttaggcctttatctgtttaggaatcagtggcccacacatgaactctgtttctctgcttccagatctactgccaaaacctgtgcctgttggccaaactttttctggaccacaagacattatattatgatgtggagcccttcctgttctatgttatgacagaggcggacaacactggctgtcacctgattggatatttttctaaggtaagcaggatctggagattaagaagccaatggccagagcagggtgatccatgttcgcagttgggggctcaaatcactgacaggaagaagctgtactctgggcaatgatgacaccccttccttaaattaaaaaaaa

SEQ ID NO: 368986 - DNA, 586 bp, Homo sapiens
tactacagtggatgtgagtgtgtagaccttgtacaatagagcttataggctaatgagaagacaggaagaaacaacaggaacacatatagctggaatgcagatgggatctgtgctacttacgctagccatgggatgattagaacaagataagagacatgaggaagacttcttcaaggaggtgctcaagccatgttttggaaaagagaactcaaggtctggcagggagaaaggagcaagggcaagtagagctgcagctgtctggcgccactgtaatgctgtctcctcctctgagtgagttcatcctggaaacattttctcccataagacatgcacaggtcttacgtttacatgtttcactgaaagaaatttgattccactgctgggatgacaaggaagactgaagaaacctaatcctaggtgctgccactgggacaaacaagaagcaccagacacagtgctgttttagggtggggcagaattatgctgagggaaaagttattatcactctttaaggccaaggaaaccacaatttttaaagaagcttctagaaattctacccagtagaaaataaagataaacttctgta

SEQ ID NO: 368987 - DNA, 1036 bp, Homo sapiens
caagtgtgagccactgtgcccggcctatgcctcaatttcttcctgccttactataggtacatcatatttatttaattccctaagtccctcctcaacagattttattctactactgaaatccagtctgcagaaactaaaagttgtatagtggatatgaaatttatataaccaccatagttcagtatctcaggggtaaaaataaaatgtgactatttatttccacaaaactgaacctatcaattcaagataacttttgctttaaaactcacgactccttgaatcaatagtcaatttctggatctttctcctcctcctaggtcctcttctccctgaaggctgtcacagttcctgtgcagagagagagggcactgcagcacccaggcgctgactgccttttgtcagtctcatttgcaggcccccagctggagaacccaggaggaagaggaaaaaagttttttcctcctctacactccccatgcatgactaaagagtaggaggagtcagcaaggtatgtgaccccaactgcaagcagaaacagcaatgaaaggactgatgatcaaacagggaccaagctacatttctgcagctatggtcagtgtgtatctggcttgtttgatgcccagaatgaattgatttttgtcgatcttcatctatacaacaaaattatcttcagtaataatcataaaaatggaatagataataacaatgtccaggaaaaaaagagtcagtaaattttaaaaattgaacttcatatatactgttatgccagaaaaaaagaaaaaagaagtgaaataaatattatagtaaaataaaaagaaatagattaaatattttataacattaatacgacttttgaaaacagggaagacttaaacctacatgtttgttgtagtatgagatgataaaattacagtttataacaaataataataaagaaaatttcaaactaaaaatatattatggctgggcatggtggctcacacctgtaatcccagcactttgggagtgtgaggtgggcagatcacctgaggtcagg

SEQ ID NO: 368988 - DNA, 1460 bp, Homo sapiens
tactacagtggatgtgagtgtgtagaccttgtacaatagagcttataggctaatgagaagacaggaagaaacaacaggaacacatatagctggaatgcagatgggatctgtgctacttacgctagccatgggatgattagaacaagataagagacatgaggaagacttcttcaaggaggtgctcaagccatgttttggaaaagagaactcaaggtctggcagggagaaaggagcaaggtcctcttctccctgaaggctgtcacagttcctgtgcagagagagagggcactgcagcacccaggcgctgactgccttttgtcagtctcatttgcaggcccccagctggagaacccaggaggaagaggaaaaaagttttttcctcctctacactccccatgcatgactaaagagtaggaggagtcagcaaggcagacatatatagtacccaggaggtggacaaacaactgccttggtggaaactctgtcctttctggacttatcctggtgccactgagactgtgcagatttagatctacaatccacctggaattgatttttgtatatggagtgaggtcccacacttacagggaaagcatcacccgaaagtgagaatgcctagaggcaggaatcatggaggcttccttaaccgtctgtctgcaacagcaggtgctagagatgacactgcagagtagagaacaaaggaatcttagtaattgttcaatccaatctccacactttaaagatgaagaaactggtattgagaaaaatacacagcttatccaaggttgcactgctggttggtagctgagatgaatttagaacccacatctgatgactacaccatattgctcccagttttcctgtctgttccacatgtaaaagtctgactcttcacttctcctttgagtatatagacttttaacatttttgtatgtcaagatggacttttcctcatacccagcccctgccttttctcctcccttcataccttgcaggatctttaacagaatttaaaaggagttttttgttttgttttgatgtatctaataaaagtcaagggagggagagggccagtataagcaagagtacagtttcctagtttgtagatgcggtagtctgaggaatcagaaacacacaaaggtttggagaactggtacatgctcccaggtgggaagccaggactcttggtaggatcttgaggacaaggcaaaggacaataagagagcgaggggatcctagaggtggaatcaaggaagagaaactagagagagaaaaaggaactggctatccatccatgatggatcctgtgtggactgatgggtggcttggcatcatcctttagtagacttcatgtggttgaataattggccaatggaaggaatttcttttttggtaacagactctgtgtgtacagttatgggtcttaatttataataaaaggttacattgaaaattgaaaa

SEQ ID NO: 368989 - DNA, 624 bp, Homo sapiens
tactacagtggatgtgagtgtgtagaccttgtacaatagagcttataggctaatgagaagacaggaagaaacaacaggaacacatatagctggaatgcagatgggatctgtgctacttacgctagccatgggatgattagaacaagataagagacatgaggaagacttcttcaaggaggtgctcaagccatgttttggaaaagagaactcaaggtctggcagggagaaaggagcaagggcaagtagagctgcagctgtctggcgccactgtaatgctgtctcctcctctgagtgagttcatcctggaaacattttctcccataagacatgcacaggtcttacgtttacatgtttcactgaaagaaatttgattccactgctgggatgacaaggaagactgaagaaacctaatcctaggtgctgccactgggacaaacaagaagcaccagacacagtgctgttttagggtggggcagaattatgctgagggaaaagttattatcactctttaaggccaaggaaaccacaatttttaaagaagcttctagaaattctacccagtagaaaataaagataaacttctgtaaggaatttcattcttttcagaattcgcaatctgaaatg

SEQ ID NO: 368990 - DNA, 1119 bp, Homo sapiens
tactacagtggatgtgagtgtgtagaccttgtacaatagagcttataggctaatgagaagacaggaagaaacaacaggaacacatatagctggaatgcagatgggatctgtgctacttacgctagccatgggatgattagaacaagataagagacatgaggaagacttcttcaaggaggtgctcaagccatgttttggaaaagagaactcaaggtctggcagggagaaaggagcaagactgcctggcagctctttagaaagttgtgtgacgtatgaaccagttcttccctatatgagagtgtaccgtacatcgcaggctgtccagcatcgaccccactgatggatgctagtagtcctccccgccagcactcaacattgtgacagtcaaaaacatcctctctacattttcaatgcccctgttggggtagcaggactcccactgagagaccccagtagagatgcccagtagagatggtccccaagcatgctaaccatgaagcagtgatatcgcacagcacctgcttccagcagcccggagccaaggggcaaagcttttaacccccactacgcgtcttcgttccattctcctccagtacccattttagtgagcttctgttgtttctgccccaggatatctctaacaaagaaccaagatatttatcaggagaacttctcccactctcctctcagtccttggggatctgatgaaatgacacttcttggactgtggggtggagcatgtgagtcacacctgggccaatcattttatcctatttcgtgaccacatgaccaattcagggatgggaacatgacccaggtggaacctatgagaggcagtgagatctttccaggtacttccaggaaagagggtctcacttttccctctataatgtacaccagagaaggtgtgtggctgaagctgctaccatcctcttgtggctacaggaagctgggattaattgtaacaacgcaattggcagatctgaaagctgagaacaaaaaagcaaaaaacctgtgttctaataacactatatatgagccctaaatccagctatgcctggagccagtcttactgtggaatttttaacctaagctggttgataaattatcttttcattt

SEQ ID NO: 368991 - DNA, 797 bp, Homo sapiens
tactacagtggatgtgagtgtgtagaccttgtacaatagagcttataggctaatgagaagacaggaagaaacaacaggaacacatatagctggaatgcagatgggatctgtgctacttacgctagccatgggatgattagaacaagataagagacatgaggaagacttcttcaaggaggtgctcaagccatgttttggaaaagagaactcaaggtctggcagggagaaaggagcaaggtcctcttctccctgaaggctgtcacagttcctgtgcagagagagagggcactgcagcacccaggcgctgactgccttttgtcagtctcatttgcaggcccccagctggagaacccaggaggaagaggaaaaaagttttttcctcctctacactccccatgcatgactaaagagtaggaggagtcagcaaggcagacatatatagtacccaggaggtggacaaacaactgccttggtggaaactctgtcctttctggacttatcctggtgccactgagactgtgcaggtcccacacttacagggaaagcatcacccgaaagtgagaatgcctagaggcaggaatcatggaggcttccttaaccgtctgtctgcaacagcaggtgctagagatgacactgcagagtagagaacaaaggaatcttagtaattgttcaatccaatctccacactttaaagatgaagaaactggtattgagatttgaggctacccatatggtcccaggttcctgctggtcaacaggtagccggctccttacttctccttggtatgacttatact

SEQ ID NO: 368992 - DNA, 1492 bp, Homo sapiens
caagtgtgagccactgtgcccggcctatgcctcaatttcttcctgccttactataggtacatcatatttatttaattccctaagtccctcctcaacagattttattctactactgaaatccagtctgcagaaactaaaagttgtatagtggatatgaaatttatataaccaccatagttcagtatctcaggggtaaaaataaaatgtgactatttatttccacaaaactgaacctatcaattcaagataacttttgctttaaaactcacgactccttgaatcaatagtcaatttctggatctttctcctcctcctaggtcctcttctccctgaaggctgtcacagttcctgtgcagagagagagggcactgcagcacccaggcgctgactgccttttgtcagtctcatttgcaggcccccagctggagaacccaggaggaagaggaaaaaagttttttcctcctctacactccccatgcatgactaaagagtaggaggagtcagcaaggcagacatatatagtacccaggaggtggacaaacaactgccttggtggaaactctgtcctttctggacttatcctggtgccactgagactgtgcaggtcccacacttacagggaaagcatcacccgaaagtgagaatgcctagaggcaggaatcatggaggcttccttaaccgtctgtctgcaacagcaggtgctagagatgacactgcagagtagagaacaaaggaatcttagtaattgttcaatccaatctccacactttaaagatgaagaaactggtattgagaaaaatacacagcttatccaaggttgcactgctggttggtagctgagatgaatttagaacccacatctgatgactacaccatattgctcccagttttcctgtctgttccacatgtaaaagtctgactcttcacttctcctttgagtatatagacttttaacatttttgtatgtcaagatggacttttcctcatacccagcccctgccttttctcctcccttcataccttgcaggatctttaacagaatttaaaaggagttttttgttttgttttgatgtatctaataaaagtcaagggagggagagggccagtataagcaagagtacagtttcctagtttgtagatgcggtagtctgaggaatcagaaacacacaaaggtttggagaactggtacatgctcccaggtgggaagccaggactcttggtaggatcttgaggacaaggcaaaggacaataagagagcgaggggatcctagaggtggaatcaaggaagagaaactagagagagaaaaaggaactggctatccatccatgatggatcctgtgtggactgatgggtggcttggcatcatcctttagtagacttcatgtggttgaataattggccaatggaaggaatttcttttttggtaacagactctgtgtgtacagttatgggtcttaatttataataaaaggttacattgaaaattgaaaa

SEQ ID NO: 368993 - DNA, 825 bp, Homo sapiens
tttcattaatttctggtttattttattttaggtgctagagatgacactgcagagtagagaacaaaggaatcttagtaattgttcaatccaatctccacactttaaagatgaagaaactggtattgagaaaaatacacagcttatccaaggttgcactgctggttggtagctgagatgaatttagaacccacatctgatgactacaccatattgctcccagttttcctgtctgttccacatgtaaaagtctgactcttcacttctcctttgagtatatagacttttaacatttttgtatgtcaagatggacttttcctcatacccagcccctgccttttctcctcccttcataccttgcaggatctttaacagaatttaaaaggagttttttgttttgttttgatgtatctaataaaagtcaagggagggagagggccagtataagcaagagtacagtttcctagtttgtagatgcggtagtctgaggaatcagaaacacacaaaggtttggagaactggtacatgctcccaggtgggaagccaggactcttggtaggatcttgaggacaaggcaaaggacaataagagagcgaggggatcctagaggtggaatcaaggaagagaaactagagagagaaaaaggaactggctatccatccatgatggatcctgtgtggactgatgggtggcttggcatcatcctttagtagacttcatgtggttgaataattggccaatggaaggaatttcttttttggtaacagactctgtgtgtacagttatgggtcttaatttataataaaaggttacattgaaaattgaaaa

SEQ ID NO: 368994 - DNA, 1715 bp, Homo sapiens
tactacagtggatgtgagtgtgtagaccttgtacaatagagcttataggctaatgagaagacaggaagaaacaacaggaacacatatagctggaatgcagatgggatctgtgctacttacgctagccatgggatgattagaacaagataagagacatgaggaagacttcttcaaggaggtgctcaagccatgttttggaaaagagaactcaaggtctggcagggagaaaggagcaagactgcctggcagctctttagaaagttgtgtgacgtatgaaccagttcttccctatatgagagtgtaccgtacatcgcaggctgtccagcatcgaccccactgatggatgctagtagtcctccccgccagcactcaacattgtgacagtcaaaaacatccccagtagagatggtccccaagcatgctaaccatgaagcagtgatatcgcacagcacctgcttccagcagcccggagccaaggggcaaaatggaaagagtcagcatttctcttttaggttctctgcctctctagtgtgtaagcttttaacccccactacgcgtcttcgttccattctcctccagtacccattttagtgagcttctgttgtttctgccccaggatatctctaacaaagaaccaagatatttatcaggagaattgctggagccaagtaggcagaagttgcatgtgctgagatcacgccactgcactccagcctgggtgacagagcaagactctgcctcaaaaagaaacattaaaaaaaaattaataaataaataagaaatcatcagtgaacttgaagaccagtcaacggatattatttaatcagaaagaaaaaaagattagaataaaaagaagaatagggcctaaaaatcctgtgggataatatcaagcagtctaacatatgtatatttagagctccagaaagagaagagaaacagaatgaagtagaaaaagtatttgaagaaatattgactggaaagccaggcacagtggctcacacctataatctcagcactttgggaagccaagatggaaggattacttgagcccaggagttcgggaccagcctgggcaacatagcaagacccagtctctacaaaaaaattaaaaaattagacaggcatggtggtgtgtacttgtagtcccacctactcaggagactgaggcaggaggatcacttgagcccagggggtcaaggctgtagtgagccgtgattgtaccactgccctccagcctgggtgatgagtgagatgctgtctcaaaaaaaaaaaaaagaaagaaaagaaatattgacaggaaaatcttccggtttgatcaaaaacagtaacctcagcaaactcccagtagaattatttcagccatttagatgtctctgacccaaaacccagccccacccaactcactgacaagacacaaggtaatatacagaccaagaatttctgcaaggataatagggcctgagatgagggtacagatattcagaggcagtgccgacactgaaaaaattccacaggtttcttctcagaatcttgctgactccagaaaacaagtctagagtatacttttcctactgaaggatctgacagtcctctttcaggccaccctgagacgggctccataatattttgaaagtattaggttgatttgactttagcttcaattctacttaaaggaaagatatatttagatagagaatagatttctgggagctaga

SEQ ID NO: 368995 - DNA, 1661 bp, Homo sapiens
tactacagtggatgtgagtgtgtagaccttgtacaatagagcttataggctaatgagaagacaggaagaaacaacaggaacacatatagctggaatgcagatgggatctgtgctacttacgctagccatgggatgattagaacaagataagagacatgaggaagacttcttcaaggaggtgctcaagccatgttttggaaaagagaactcaaggtctggcagggagaaaggagcaagactgcctggcagctctttagaaagttgtgtgacgtatgaaccagttcttccctatatgagagtgtaccgtacatcgcaggctgtccagcatcgaccccactgatggatgctagtagtcctccccgccagcactcaacattgtgacagtcaaaaacatccccagtagagatggtccccaagcatgctaaccatgaagcagtgatatcgcacagcacctgcttccagcagcccggagccaaggggcaaaatggaaagagtcagcatttctcttttaggttctctgcctctctagtgtgtaagcttttaacccccactacgcgtcttcgttccattctcctccagtacccattttagtgagcttctgttgtttctgccccaggatatctctaacaaagaaccaagatatttatcaggagaattgctggagccaagtaggcagaagttgcatgtgctgagatcacgccactgcactccagcctgggtgacagagcaagactctgcctcaaaaagaaacattaaaaaaaaattaataaataaataagaaatcatcagtgaacttgaagaccagtcaacggatattatttaatcagaaagaaaaaaagattagaataaaaagaagaatagggcctaaaaatcctgtgggataatatcaagcagtctaacatatgtatatttagagctccagaaagagaagagaaacagaatgaagtagataatctcagcactttgggaagccaagatggaaggattacttgagcccaggagttcgggaccagcctgggcaacatagcaagacccagtctctacaaaaaaattaaaaaattagacaggcatggtggtgtgtacttgtagtcccacctactcaggagactgaggcaggaggatcacttgagcccagggggtcaaggctgtagtgagccgtgattgtaccactgccctccagcctgggtgatgagtgagatgctgtctcaaaaaaaaaaaaaagaaagaaaagaaatattgacaggaaaatcttccggtttgatcaaaaacagtaacctcagcaaactcccagtagaattatttcagccatttagatgtctctgacccaaaacccagccccacccaactcactgacaagacacaaggtaatatacagaccaagaatttctgcaaggataatagggcctgagatgagggtacagatattcagaggcagtgccgacactgaaaaaattccacaggtttcttctcagaatcttgctgactccagaaaacaagtctagagtatacttttcctactgaaggatctgacagtcctctttcaggccaccctgagacgggctccataatattttgaaagtattaggttgatttgactttagcttcaattctacttaaaggaaagatatatttagatagagaatagatttctgggagctaga

SEQ ID NO: 368996 - DNA, 1287 bp, Homo sapiens
agcataatgaacacaacataaaaaatcagtgaggctggatgcggtggctcacgcctgtaattccagcactttgggaggccgaggtgggcaggtcacttgaggtcaggagttcaagaccaggctggccaacatggtgaaaccccatctctactaaaaatacaaaaattgacctggcgtggtggtgggcacctgtaatcccagctactcaggaggccgaggcaggagaattgctggagccaagtaggcagaagttgcatgtgctgagatcacgccactgcactccagcctgggtgacagagcaagactctgcctcaaaaagaaacattaaaaaaaaattaataaataaataagaaatcatcagtgaacttgaagaccagtcaacggatattatttaatcagaaagaaaaaaagattagaataaaaagaagaatagggcctaaaaatcctgtgggataatatcaagcagtctaacatatgtatatttagagctccagaaagagaagagaaacagaatgaagtagaaaaagtatttgaagaaatattgactggaaagccaggcacagtggctcacacctataatctcagcactttgggaagccaagatggaaggattacttgagcccaggagttcgggaccagcctgggcaacatagcaagacccagtctctacaaaaaaattaaaaaattagacaggcatggtggtgtgtacttgtagtcccacctactcaggagactgaggcaggaggatcacttgagcccagggggtcaaggctgtagtgagccgtgattgtaccactgccctccagcctgggtgatgagtgagatgctgtctcaaaaaaaaaaaaaagaaagaaaagaaatattgacaggaaaatcttccggtttgatcaaaaacagtaacctcagcaaactcccagtagaattatttcagccatttagatgtctctgacccaaaacccagccccacccaactcactgacaagacacaaggtaatatacagaccaagaatttctgcaaggataatagggcctgagatgagggtacagatattcagaggcagtgccgacactgaaaaaattccacaggtttcttctcagaatcttgctgactccagaaaacaagtctagagtatacttttcctactgaaggatctgacagtcctctttcaggccaccctgagacgggctccataatattttgaaagtattaggttgatttgactttagcttcaattctacttaaaggaaagatatatttagatagagaatagatttctgggagctaga

SEQ ID NO: 368997 - DNA, 1296 bp, Homo sapiens
aaaatttttggtagagatgaagcctcactgtattgcctaggctggtctcgagctcctgtgctcaagcaatcatcccactttgggaggccgaggtgggcaggtcacttgaggtcaggagttcaagaccaggctggccaacatggtgaaaccccatctctactaaaaatacaaaaattgacctggcgtggtggtgggcacctgtaatcccagctactcaggaggccgaggcaggagaattgctggagccaagtaggcagaagttgcatgtgctgagatcacgccactgcactccagcctgggtgacagagcaagactctgcctcaaaaagaaacattaaaaaaaaattaataaataaataagaaatcatcagtgaacttgaagaccagtcaacggatattatttaatcagaaagaaaaaaagattagaataaaaagaagaatagggcctaaaaatcctgtgggataatatcaagcagtctaacatatgtatatttagagctccagaaagagaagagaaacagaatgaagtagaaaaagtatttgaagaaatattgactggaaagccaggcacagtggctcacacctataatctcagcactttgggaagccaagatggaaggattacttgagcccaggagttcgggaccagcctgggcaacatagcaagacccagtctctacaaaaaaattaaaaaattagacaggcatggtggtgtgtacttgtagtcccacctactcaggagactgaggcaggaggatcacttgagcccagggggtcaaggctgtagtgagccgtgattgtaccactgccctccagcctgggtgatgagtgagatgctgtctcaaaaaaaaaaaaaagaaagaaaagaaatattgacaggaaaatcttccggtttgatcaaaaacagtaacctcagcaaactcccagtagaattatttcagccatttagatgtctctgacccaaaacccagccccacccaactcactgacaagacacaaggtaatatacagaccaagaatttctgcaaggataatagggcctgagatgagggtacagatattcagaggcagtgccgacactgaaaaaattccacaggtttcttctcagaatcttgctgactccagaaaacaagtctagagtatacttttcctactgaaggatctgacagtcctctttcaggccaccctgagacgggctccataatattttgaaagtattaggttgatttgactttagcttcaattctacttaaaggaaagatatatttagatagagaatagatttctgggagctaga

SEQ ID NO: 368998 - DNA, 1729 bp, Homo sapiens
tactacagtggatgtgagtgtgtagaccttgtacaatagagcttataggctaatgagaagacaggaagaaacaacaggaacacatatagctggaatgcagatgggatctgtgctacttacgctagccatgggatgattagaacaagataagagacatgaggaagacttcttcaaggaggtgctcaagccatgttttggaaaagagaactcaaggtctggcagggagaaaggagcaagactgcctggcagctctttagaaagttgtgtgacgtatgaaccagttcttccctatatgagagtgtaccgtacatcgcaggctgtccagcatcgaccccactgatggatgctagtagtcctccccgccagcactcaacattgtgacagtcaaaaacatcctctctacattttcaatgcccctgttggggtagcaggactcccactgagagaccccagtagagatgcccagtagagatggtccccaagcatgctaaccatgaagcagtgatatcgcacagcacctgcttccagcagcccggagccaaggggcaaagcttttaacccccactacgcgtcttcgttccattctcctccagtacccattttagtgagcttctgttgtttctgccccaggatatctctaacaaagaaccaagatatttatcaggagaattgctggagccaagtaggcagaagttgcatgtgctgagatcacgccactgcactccagcctgggtgacagagcaagactctgcctcaaaaagaaacattaaaaaaaaattaataaataaataagaaatcatcagtgaacttgaagaccagtcaacggatattatttaatcagaaagaaaaaaagattagaataaaaagaagaatagggcctaaaaatcctgtgggataatatcaagcagtctaacatatgtatatttagagctccagaaagagaagagaaacagaatgaagtagaaaaagtatttgaagaaatattgactggaaagccaggcacagtggctcacacctataatctcagcactttgggaagccaagatggaaggattacttgagcccaggagttcgggaccagcctgggcaacatagcaagacccagtctctacaaaaaaattaaaaaattagacaggcatggtggtgtgtacttgtagtcccacctactcaggagactgaggcaggaggatcacttgagcccagggggtcaaggctgtagtgagccgtgattgtaccactgccctccagcctgggtgatgagtgagatgctgtctcaaaaaaaaaaaaaagaaagaaaagaaatattgacaggaaaatcttccggtttgatcaaaaacagtaacctcagcaaactcccagtagaattatttcagccatttagatgtctctgacccaaaacccagccccacccaactcactgacaagacacaaggtaatatacagaccaagaatttctgcaaggataatagggcctgagatgagggtacagatattcagaggcagtgccgacactgaaaaaattccacaggtttcttctcagaatcttgctgactccagaaaacaagtctagagtatacttttcctactgaaggatctgacagtcctctttcaggccaccctgagacgggctccataatattttgaaagtattaggttgatttgactttagcttcaattctacttaaaggaaagatatatttagatagagaatagatttctgggagctaga

SEQ ID NO: 368999 - DNA, 1105 bp, Homo sapiens
tactacagtggatgtgagtgtgtagaccttgtacaatagagcttataggctaatgagaagacaggaagaaacaacaggaacacatatagctggaatgcagatgggatctgtgctacttacgctagccatgggatgattagaacaagataagagacatgaggaagacttcttcaaggaggtgctcaagccatgttttggaaaagagaactcaaggtctggcagggagaaaggagcaagactgcctggcagctctttagaaagttgtgtgacgtatgaaccagttcttccctatatgagagtgtaccgtacatcgcaggctgtccagcatcgaccccactgatggatgctagtagtcctccccgccagcactcaacattgtgacagtcaaaaacatccccagtagagatggtccccaagcatgctaaccatgaagcagtgatatcgcacagcacctgcttccagcagcccggagccaaggggcaaaatggaaagagtcagcatttctcttttaggttctctgcctctctagtgtgtaagcttttaacccccactacgcgtcttcgttccattctcctccagtacccattttagtgagcttctgttgtttctgccccaggatatctctaacaaagaaccaagatatttatcaggagaacttctcccactctcctctcagtccttggggatctgatgaaatgacacttcttggactgtggggtggagcatgtgagtcacacctgggccaatcattttatcctatttcgtgaccacatgaccaattcagggatgggaacatgacccaggtggaacctatgagaggcagtgagatctttccaggtacttccaggaaagagggtctcacttttccctctataatgtacaccagagaaggtgtgtggctgaagctgctaccatcctcttgtggctacaggaagctgggattaattgtaacaacgcaattggcagatctgaaagctgagaacaaaaaagcaaaaaacctgtgttctaataacactatatatgagccctaaatccagctatgcctggagccagtcttactgtggaatttttaacctaagctggttgataaattatcttttcattt

SEQ ID NO: 369000 - DNA, 766 bp, Homo sapiens
tactacagtggatgtgagtgtgtagaccttgtacaatagagcttataggctaatgagaagacaggaagaaacaacaggaacacatatagctggaatgcagatgggatctgtgctacttacgctagccatgggatgattagaacaagataagagacatgaggaagacttcttcaaggaggtgctcaagccatgttttggaaaagagaactcaaggtctggcagggagaaaggagcaagactgcctggcagctctttagaaagttgtgtgacgtatgaaccagttcttccctatatgagagtgtaccgtacatcgcaggctgtccagcatcgaccccactgatggatgctagtagtcctccccgccagcactcaacattgtgacagtcaaaaacatccccagtagagatggtccccaagcatgctaaccatgaagcagtgatatcgcacagcacctgcttccagcagcccggagccaaggggcaaaatggaaagagtcagcatttctcttttaggttctctgcctctctagtgtgtgaagactgaagaaacctaatcctaggtgctgccactgggacaaacaagaagcaccagacacagtgctgttttagggtggggcagaattatgctgagggaaaagttattatcactctttaaggccaaggaaaccacaatttttaaagaagcttctagaaattctacccagtagaaaataaagataaacttctgtaaggaatttcattcttttcagaattcgcaatctgaaatg

SEQ ID NO: 369001 - DNA, 982 bp, Homo sapiens
caagtgtgagccactgtgcccggcctatgcctcaatttcttcctgccttactataggtacatcatatttatttaattccctaagtccctcctcaacagattttattctactactgaaatccagtctgcagaaactaaaagttgtatagtggatatgaaatttatataaccaccatagttcagtatctcaggggtaaaaataaaatgtgactatttatttccacaaaactgaacctatcaattcaagataacttttgctttaaaactcacgactccttgaatcaatagtcaatttctggatctttctcctcctcctaggtcctcttctccctgaaggctgtcacagttcctgtgcagagagagagggcactgcagcacccaggcgctgactgccttttgtcagtctcatttgcaggcccccagctggagaacccaggaggaagaggaaaaaagttttttcctcctctacactccccatgcatgactaaagagtaggaggagtcagcaaggtatgtgaccccaactgcaagcagaaacagcaatgaaaggactgatgatcaaacagggaccaagctacatttctgtgtcgatcttcatctatacaacaaaattatcttcagtaataatcataaaaatggaatagataataacaatgtccaggaaaaaaagagtcagtaaattttaaaaattgaacttcatatatactgttatgccagaaaaaaagaaaaaagaagtgaaataaatattatagtaaaataaaaagaaatagattaaatattttataacattaatacgacttttgaaaacagggaagacttaaacctacatgtttgttgtagtatgagatgataaaattacagtttataacaaataataataaagaaaatttcaaactaaaaatatattatggctgggcatggtggctcacacctgtaatcccagcactttgggagtgtgaggtgggcagatcacctgaggtcagg

SEQ ID NO: 369002 - DNA, 1171 bp, Homo sapiens
tactacagtggatgtgagtgtgtagaccttgtacaatagagcttataggctaatgagaagacaggaagaaacaacaggaacacatatagctggaatgcagatgggatctgtgctacttacgctagccatgggatgattagaacaagataagagacatgaggaagacttcttcaaggaggtgctcaagccatgttttggaaaagagaactcaaggtctggcagggagaaaggagcaagactgcctggcagctctttagaaagttgtgtgacgtatgaaccagttcttccctatatgagagtgtaccgtacatcgcaggctgtccagcatcgaccccactgatggatgctagtagtcctccccgccagcactcaacattgtgacagtcaaaaacatcctctctacattttcaatgcccctgttggggtagcaggactcccactgagagaccccagtagagatgcccagtagagatggtccccaagcatgctaaccatgaagcagtgatatcgcacagcacctgcttccagcagcccggagccaaggggcaaaatggaaagagtcagcatttctcttttaggttctctgcctctctagtgtgtaagcttttaacccccactacgcgtcttcgttccattctcctccagtacccattttagtgagcttctgttgtttctgccccaggatatctctaacaaagaaccaagatatttatcaggagaacttctcccactctcctctcagtccttggggatctgatgaaatgacacttcttggactgtggggtggagcatgtgagtcacacctgggccaatcattttatcctatttcgtgaccacatgaccaattcagggatgggaacatgacccaggtggaacctatgagaggcagtgagatctttccaggtacttccaggaaagagggtctcacttttccctctataatgtacaccagagaaggtgtgtggctgaagctgctaccatcctcttgtggctacaggaagctgggattaattgtaacaacgcaattggcagatctgaaagctgagaacaaaaaagcaaaaaacctgtgttctaataacactatatatgagccctaaatccagctatgcctggagccagtcttactgtggaatttttaacctaagctggttgataaattatcttttcattt

SEQ ID NO: 369003 - DNA, 743 bp, Homo sapiens
tactacagtggatgtgagtgtgtagaccttgtacaatagagcttataggctaatgagaagacaggaagaaacaacaggaacacatatagctggaatgcagatgggatctgtgctacttacgctagccatgggatgattagaacaagataagagacatgaggaagacttcttcaaggaggtgctcaagccatgttttggaaaagagaactcaaggtctggcagggagaaaggagcaagagtagactttgagtctttgcttcagatgcagatcaagatgtggcaacctgttgtggagaactgggtcccttgagcctgtgctgtctctttttttctggtggctttgtcatttggaacaatgcataatgggctggaggctgagaaactctgagctgagggcaagtagagctgcagctgtctggcgccactgtaatgctgtctcctcctctgagtgagttcatcctggaaacattttctcccataagacatgcacaggtcttacgtttacatgtttcactgaaagaaatttgattccactgctgggatgacaaggaagactgaagaaacctaatcctaggtgctgccactgggacaaacaagaagcaccagacacagtgctgttttagggtggggcagaattatgctgagggaaaagttattatcactctttaaggccaaggaaaccacaatttttaaagaagcttctagaaattctacccagtagaaaataaagataaacttctgta

SEQ ID NO: 369004 - DNA, 721 bp, Homo sapiens
tacagtggatgtgagtgtgtagaccttgtacaatagagcttataggctaatgagaagacaggaagaaacaacaggaacacatatagctggaatgcagatgggatctgtgctacttacgctagccatgggatgattagaacaagataagagacatgaggaagacttcttcaaggaggtgctcaagccatgttttggaaaagagaactcaaggtctggcagggagaaaggagcaaggtaaccaggggaagtcttggaggagagcaagatgatgctgaaactgccctcactgttggttttaatgttgttcttgtcttactggtcgattcagagcattcacggtgcaagagagatagggacatttgatttaagaaatagagcagaatctcctcaaattaaatcagaatttttgatggagtagaggtcagagctatgttttggaagtgtttgggaaattgttagttttgttcccaggatctgatgcttttgtggttgaatattccatgtgaatgttttctctgcccatgcaaatagtaggtctcccagacaaatatctcagtggtgccagcacttcattttccaaatgtaggaggatctttctaatacttcctttgtggggaacatgaaactgttggaggcttgtaatcatatctatattttaaagaaagattttttttatcaacaggctatatggaaatatattcaaaactgttagtattatggt

SEQ ID NO: 369005 - DNA, 851 bp, Homo sapiens
agcgctgacggtacgccatgtccccagctcactgcatcttccactcccgggttcaaacgattctcctacttcagcctcccgaatagctgggattacaggcgtgtgccaccacacccagcaaatattgtacttttagtagagatggggtttcgccatgttgcccaggctggtctcaaactcctgagctcaagccatcctcccgcctccaactcccaaagtgctaggcgtgagccactgcgcccggcctcagtatgtatttaagtggcaggaaggtgctgagcttgccgctggggaggagtgatgactttagagctctctctctgccctcatggaacctgctgtctagcagggaggaggacggtagtgctcattgtttggaagaccacagcctgcattgatcgcggggacttgagcattcgtgtccatggtttgggagtccctggctcccatagtacatgttttatgaaggaaactaccagaaatccatgattagagatggaaaatatcagaccaattggaaattttcctttgactctcacctggtctgagcatcttctgtctttttggtacagtgaactactccagattgaaaacatttctgttttctccttgcctggcaagtgagctcagtgaaacatcctattagccacactgcagggttggacattgccacaccaggtcaagggaaagtggcactatgaaggcctgggcagcactgctgctttgagaattacgaggagaaaatctgtgctttaccaaaaagtaaattaaagatcctgcctggtatcagccttgcttgagtgactagtaaaattgcagaatagcttcataggaaaaaacaaaccccagag

SEQ ID NO: 369006 - DNA, 514 bp, Homo sapiens
cttcctgcccaccctctccccagccgcccgtttcaagccatgctgcccctctcagcctgtgagaattggctgtgctacctcttctgttccgcaacaccacagtggtagtttgaaatcggccacgggggaaatatttacaccagggaaatgagcagattggaggactcaggacttttccgagagctggttattagccatttaccagcacatcaccaacctatgctatttataaaccaccttctgccaacctggagtccagcttagcttcgtgtcaaaacgcaacctgatgctgactcagatgggcaaatcatcattacttattttttattctcacacacaagtaactttagaaaggactaaattgtaaaataaattttttaaaagaacaaaagaaatacgggtttcccccccatagagggaaaggcccatagaaatgaaattttactataaaaatgcaacaactggccaggcgcaatggctcattcctgaaatcccagcactttgggagcccgag

SEQ ID NO: 369007 - DNA, 939 bp, Homo sapiens
  misc_feature (874)..(874): n is a, c, g, or t
ctcccgtcacccaggctggagtgcagtggcacaattgttaccggaaagggatcccaatccagaccccaagaggattcttggaccttgagtaagaaagaattcagagagatggtctcgctatgttgcccaggctggtcctgaactcctggcctaaagcgatcctcctgcctcggccccccaaagtgctgaaattacaggtctcaaacaaaagtctggaacctgggattcttgtaggatatctggctgtgctttgtattatatgaaccacagaaaataatcttccagtatgatattgttttcagtatagtacctcaaccctaatttgcctggtaaccctttatccagagacctttgttttcaacttacagtcttattctggggtgggggatgtacagtctggctgtgtggacttgcaggagagatttagggttctaacttcttcttactgacttccaaccaattctcctgtattcagtcttatacacacccccacttatactagacgtagctggtactaccaaagcctggtcacaaaactctatgggagtctcaatgcaagttgagttgcttcttgactttcatccctgctggcttaagactcagcttcacaagcctgctaagtcagttgctatttatcctgttttctagcccttcaaaattttaaatgaaaatttacatttttaattgacaaataatatatatatgggataaatatgatgttttgatagtaatagatgtactgtggatggtattgaggtattgaattcaatctaaattttttgctgtgggacgtaacatttggcagaaggggtcactgtataactggagcggggaaaggggcagttggtcaacccgtgaaaaacctttaacaaangggcgaatagggaagcaatgaagcaaggaaaggcagaagtggtgcgcaaatttggttagttttga

SEQ ID NO: 369008 - DNA, 4445 bp, Homo sapiens
  misc_feature (2490)..(2490): n is a, c, g, or t
  misc_feature (3077)..(3077): n is a, c, g, or t
  misc_feature (3138)..(3138): n is a, c, g, or t
  misc_feature (3151)..(3151): n is a, c, g, or t
  misc_feature (3218)..(3218): n is a, c, g, or t
  misc_feature (3287)..(3287): n is a, c, g, or t
  misc_feature (3390)..(3390): n is a, c, g, or t
  misc_feature (3523)..(3523): n is a, c, g, or t
  misc_feature (3527)..(3527): n is a, c, g, or t
  misc_feature (3970)..(3970): n is a, c, g, or t
gcggccgcttctcgaagctctccccgagcctcaggcaatgttcctcgcggtccagcagcgggtttgcggtcccattcatggccccgcacctgcctcgcacccagatcggcgctctcccggtgcagccgcgatccgagcttctggcgctggcgtctgggaggactgtgcttccgggccaccgctctggaagacaaggagagccgagccggcacccacccgggtccagaagcaagttctctcctctgcgtgggggtgagagaggaatctgaggaggcaaggccgtgggacttccggcgtcgggtaggaacttccgggttcctagcggaagtggcgggggcggtgccatggcaaaagaactcccggagaatccgaattcgtggtcctcagaattggtttagggttgtttcgcggttcttcccgtattctgcctccgaggcccagtggggctggctgtgggccccctgtgctgtttgaggcgtgaaactcacctcaggaaatgtatctgatccattagcgtggattcatattatttggtgatggagaatcttcagctgtgttaagtgttaccgtcagtttcagagatggcttctttgcaaaggaaagggctgcaggcaaggattctcacctctgaagaagaggagaaactgaaaagagaccaaactttggtgtctgattttaaacagcagaaattggaacaagaggctcagaaaaattgggatcttttttacaaaagaaatagcactaatttcttcaaagacagacactggaccaccagagagtttgaggagctaagatcatgtagagagtttgaagatcaaaagttaacaatgcttgaagctggctgtggggttggaaactgtttattcccacttttagaagaagatccgaatatctttgcctatgcctgtgatttttctccaagagccattgaatatgttaagcaaaatcctttatatgatacagaaagatgcaaggtattccagtgtgatctgactaaagatgatcttctggatcatgtaccgccagagtctgtggatgttgttatgttgatatttgtgctgtcagctgttcatcctgataagatgcaccttgtcttacaaaacatttacaagtgccatggctgctcttcagagcttcgccagccctgggacaaggatgattttgcagttacctgggatccatggagtcctgctataaggtattaaaaccaggcaaaagtgtcttgtttcgtgactacggactgtatgatcatgccatgcttaggtttaaagccagcagcaaacttggagaaaacttttatgttagacaagatgggaccagatcatatttttttactgatgacttcctggctcagctctttatggacacaggttatgaagaagtggtaaacgagtatgtgtttcgagagacggtgaataaaaaagaaggcctgtgtgtgccaagagttttccttcagagcaaatttctaaagcctcctaagaacccatctcctgtggtcctgggcctggatcctaagtcctgacctttcatgaggtctcaaacaaaagtctggaacctgggattcttgtaggatatctggctgtgctttgtattatatgaaccacagaaaataatcttccagtatgatattgttttcagtatagtacctcaaccctaatttgcctggtaaccctttatccagagacctttgttttcaacttacagtcttattctggggtgggggatgtacagtctggctgtgtggacttgcaggagagatttagggttctaacttcttcttactgacttccaaccaattctcctgtattcagtcttatacacacccccacttatactagacgtagctggtactaccaaagcctggtcacaaaactctatgggagtctcaatgcaagttgagttgcttcttgactttcatccctgctggcttaagactcagcttcacaagcctgctaagtcagttgctatttatcctgttttctagcccttcaaaattttaaatgaaaatttacatttttaattgacaaataatatatatatgggataaatatgatgttttgatagtaatagatgtatacattgtggaatgattatatgaagctaattagcatatcacactcctcacatacttctttttctttgtattgagaacatgtaaaatctattcttggccaagcatggtggctcacacctgtaattccaacactttgagaggccaaggcaggaagattgcttgagcccaggaattcaggggttccagacaccagcctgggcaacatagcaataccctgtctctaataaaaaaaaaaaaaagtaaaaataaatgtgtaatttaaaaaattcattattgttattatttttacaattttgaaactgtaggggccaggaacaaacttcccctttgccctctgaagaataactaaaaaatcactcaccaaatgcagattaataggagaaatggaataaaaacttagtaattgttttccttgntggatcccttaggtctttatgtagatagggaaaaggtttcttctagcatctgttgattgctaaggacatttaattcaaaatactcattataccagggagccatatctgggggtaaaattccagatgctccttcaaagtatacattattattgactatggtcaccatgtacagtagatctcaaaaacgtattccccctggctaactgaaatgtgtgccctttggtcaacatctcccctactcctctcctcccccagcctctggtaaccaccattctactttctgctgctgtgagttcaactttttaaaattccacgtataagtgaaatcatgtggtatttgtctttctgaatctggcttatttcacttagcataatatcttccaggttcacccatgttgttgcaaatgatagaatgtccttgtttctaatgttctcccaaatttaatcagttgtatggggtttatgtgataaaaatatccttttgctgtcattttcgtggggtttccagaaggatcctaactaggtacacatgcttagtctgtcttttttttttttttttttttgaagcaagtctccctctgttgccnggctggagtgcagtggcctgatcatgactcattgcaacctctgcctcccaggcccaagcantcctcctacctcngcctccaagtagctgggactgaaggtgtgtgccagcatgtgtggctaattttatttttgtaaagacngagtctccttatattgcccaggctggtctcaaactcctgggttcgagatcctcctgcctctgcctcccnaagtgctgggattacaggcatgagccatggtgcctggtctagtctgtcatctttaaacaattgggttgggaaggaaaaggtagcacatagatagatgatttangcagaaatagataagcataattgtccactgtaaaggggctgaatgatctggagaatggaggcatctcaggaaaactgaacttggtggtgtgtgcttaggactaatgaaaagtggccgggcacagatgctcatncctntaatcccagcacttcgggagggtgagagggagtataatttgaggccaggaattcaaggttgcagtgagccatgattgtgccactgttctccagcctgggcagcagagtgagaccccgactcttaaaaaaaaaaaaaaaagaaccaaagaaatgttagttccagggattcccagggacatgggcagggtccaagaatgatgctgagttaaggttaggtggctattcagaaagctacttcgacttgtatcccatattatggatcaaggaccttaaaaatagccatactttttttttgttctagtaactcaatttgtaggattgtttcctaagagataatctgacatattcaaggacttcttcacaaagatattcattagctgcattatttatagtaccaaacattataaatagtctaaaccagagatccacaagctatggctatnacagtgacaaggaggcctagcgtgactaactccattttgctcctaacccccctgcagcgataacctgtatcttttaggttaactgcttttgcttatctctgcacataggccaagctaactatagaaggaatttagtttatagtttagagcaaggatggtaatagtgcctcccccaaaactaacccctgaggagataaggaggatgtatgcaagtaataatgttatgttaaagatttataagagcactgtgacctgaccaaggacaaagtttcaccacctccttggacccttgccaccacccagatgtgatcactggccacttcttgacctcaactccctccctcttcccccttcctctcacgtaaaaggagcctgaaatttgtattgacttaaaaatggttcttcaggacactactcttccattttcttggtttgctggctctctgaataaaagtcactttccttgcctcaaccc

SEQ ID NO: 369009 - DNA, 4359 bp, Homo sapiens
  misc_feature (2404)..(2404): n is a, c, g, or t
  misc_feature (2991)..(2991): n is a, c, g, or t
  misc_feature (3052)..(3052): n is a, c, g, or t
  misc_feature (3065)..(3065): n is a, c, g, or t
  misc_feature (3132)..(3132): n is a, c, g, or t
  misc_feature (3201)..(3201): n is a, c, g, or t
  misc_feature (3304)..(3304): n is a, c, g, or t
  misc_feature (3437)..(3437): n is a, c, g, or t
  misc_feature (3441)..(3441): n is a, c, g, or t
  misc_feature (3884)..(3884): n is a, c, g, or t
gcggccgcttctcgaagctctccccgagcctcaggcaatgttcctcgcggtccagcagcgggtttgcggtcccattcatggccccgcacctgcctcgcacccagatcggcgctctcccggtgcagccgcgatccgagcttctggcgctggcgtctgggaggactgtgcttccgggccaccgctctggaagacaaggagagccgagccggcacccacccgggtccagaagcaagttctctcctctgcgtgggggtgagagaggaatctgaggaggcaaggccgtgggacttccggcgtcgggtaggaacttccgggttcctagcggaagtggcgggggcggtgccatggcaaaagaactcccggagaatccgaattcgtggtcctcagaattggtttagggttgtttcgcggttcttcccgtattctgcctccgaggcccagtggggctggctgtgggccccctgtgctgtttgaggcgtgaaactcacctcaggaaatgtatctgatccattagcgtggattcatattatttggtgatggagaatcttcagctgtgttaagtgttaccgtcagtttcagagatggcttctttgcaaaggaaagggctgcaggcaaggattctcacctctgaagaagaggagaaactgaaaagagaccaaactttggtgtctgattttaaacagcagaaattggaacaagaggctcagaaaaattgggatcttttttacaaaagaaatagcactaatttcttcaaagacagacactggaccaccagagagtttgaggagctaagatcatgtagagagtttgaagatcaaaagttaacaatgcttgaagctggctgtggggttggaaactgtttattcccacttttagaagaagatccgaatatctttgcctatgcctgtgatttttctccaagagccattgaatatgttaagcaaaatcctttatatgatacagaaagatgcaaggtattccagtgtgatctgactaaagatgatcttctggatcatgtaccgccagagtctgtggatgttgttatgttgatatttgtgctgtcagctgttcatcctgataagatgcaccttgtcttacaaaacatttacaaggtattaaaaccaggcaaaagtgtcttgtttcgtgactacggactgtatgatcatgccatgcttaggtttaaagccagcagcaaacttggagaaaacttttatgttagacaagatgggaccagatcatatttttttactgatgacttcctggctcagctctttatggacacaggttatgaagaagtggtaaacgagtatgtgtttcgagagacggtgaataaaaaagaaggcctgtgtgtgccaagagttttccttcagagcaaatttctaaagcctcctaagaacccatctcctgtggtcctgggcctggatcctaagtcctgacctttcatgaggtctcaaacaaaagtctggaacctgggattcttgtaggatatctggctgtgctttgtattatatgaaccacagaaaataatcttccagtatgatattgttttcagtatagtacctcaaccctaatttgcctggtaaccctttatccagagacctttgttttcaacttacagtcttattctggggtgggggatgtacagtctggctgtgtggacttgcaggagagatttagggttctaacttcttcttactgacttccaaccaattctcctgtattcagtcttatacacacccccacttatactagacgtagctggtactaccaaagcctggtcacaaaactctatgggagtctcaatgcaagttgagttgcttcttgactttcatccctgctggcttaagactcagcttcacaagcctgctaagtcagttgctatttatcctgttttctagcccttcaaaattttaaatgaaaatttacatttttaattgacaaataatatatatatgggataaatatgatgttttgatagtaatagatgtatacattgtggaatgattatatgaagctaattagcatatcacactcctcacatacttctttttctttgtattgagaacatgtaaaatctattcttggccaagcatggtggctcacacctgtaattccaacactttgagaggccaaggcaggaagattgcttgagcccaggaattcaggggttccagacaccagcctgggcaacatagcaataccctgtctctaataaaaaaaaaaaaaagtaaaaataaatgtgtaatttaaaaaattcattattgttattatttttacaattttgaaactgtaggggccaggaacaaacttcccctttgccctctgaagaataactaaaaaatcactcaccaaatgcagattaataggagaaatggaataaaaacttagtaattgttttccttgntggatcccttaggtctttatgtagatagggaaaaggtttcttctagcatctgttgattgctaaggacatttaattcaaaatactcattataccagggagccatatctgggggtaaaattccagatgctccttcaaagtatacattattattgactatggtcaccatgtacagtagatctcaaaaacgtattccccctggctaactgaaatgtgtgccctttggtcaacatctcccctactcctctcctcccccagcctctggtaaccaccattctactttctgctgctgtgagttcaactttttaaaattccacgtataagtgaaatcatgtggtatttgtctttctgaatctggcttatttcacttagcataatatcttccaggttcacccatgttgttgcaaatgatagaatgtccttgtttctaatgttctcccaaatttaatcagttgtatggggtttatgtgataaaaatatccttttgctgtcattttcgtggggtttccagaaggatcctaactaggtacacatgcttagtctgtcttttttttttttttttttttgaagcaagtctccctctgttgccnggctggagtgcagtggcctgatcatgactcattgcaacctctgcctcccaggcccaagcantcctcctacctcngcctccaagtagctgggactgaaggtgtgtgccagcatgtgtggctaattttatttttgtaaagacngagtctccttatattgcccaggctggtctcaaactcctgggttcgagatcctcctgcctctgcctcccnaagtgctgggattacaggcatgagccatggtgcctggtctagtctgtcatctttaaacaattgggttgggaaggaaaaggtagcacatagatagatgatttangcagaaatagataagcataattgtccactgtaaaggggctgaatgatctggagaatggaggcatctcaggaaaactgaacttggtggtgtgtgcttaggactaatgaaaagtggccgggcacagatgctcatncctntaatcccagcacttcgggagggtgagagggagtataatttgaggccaggaattcaaggttgcagtgagccatgattgtgccactgttctccagcctgggcagcagagtgagaccccgactcttaaaaaaaaaaaaaaaagaaccaaagaaatgttagttccagggattcccagggacatgggcagggtccaagaatgatgctgagttaaggttaggtggctattcagaaagctacttcgacttgtatcccatattatggatcaaggaccttaaaaatagccatactttttttttgttctagtaactcaatttgtaggattgtttcctaagagataatctgacatattcaaggacttcttcacaaagatattcattagctgcattatttatagtaccaaacattataaatagtctaaaccagagatccacaagctatggctatnacagtgacaaggaggcctagcgtgactaactccattttgctcctaacccccctgcagcgataacctgtatcttttaggttaactgcttttgcttatctctgcacataggccaagctaactatagaaggaatttagtttatagtttagagcaaggatggtaatagtgcctcccccaaaactaacccctgaggagataaggaggatgtatgcaagtaataatgttatgttaaagatttataagagcactgtgacctgaccaaggacaaagtttcaccacctccttggacccttgccaccacccagatgtgatcactggccacttcttgacctcaactccctccctcttcccccttcctctcacgtaaaaggagcctgaaatttgtattgacttaaaaatggttcttcaggacactactcttccattttcttggtttgctggctctctgaataaaagtcactttccttgcctcaaccc

SEQ ID NO: 369010 - DNA, 2700 bp, Homo sapiens
gcggccgcttctcgaagctctccccgagcctcaggcaatgttcctcgcggtccagcagcgggtttgcggtcccattcatggccccgcacctgcctcgcacccagatcggcgctctcccggtgcagccgcgatccgagcttctggcgctggcgtctgggaggactgtgcttccgggccaccgctctggaagacaaggagagccgagccggcacccacccgggtccagaagcaagttctctcctctgcgtgggggtgagagaggaatctgaggaggcaaggccgtgggacttccggcgtcgggtaggaacttccgggttcctagcggaagtggcgggggcggtgccatggcaaaagaactcccggagaatccgaattcgtggtcctcagaattggtttagggttgtttcgcggttcttcccgtattctgcctccgaggcccagtggggctggctgtgggccccctgtgctgtttgaggcgtgaaactcacctcaggaaatgtatctgatccattagcgtggattcatattatttggtgatggagaatcttcagctgtgttaagtgttaccgtcagtttcagagatggcttctttgcaaaggaaagggctgcaggcaaggattctcacctctgaagaagaggagaaactgaaaagagaccaaactttggtgtctgattttaaacagcagaaattggaacaagaggctcagaaaaattgggatcttttttacaaaagaaatagcactaatttcttcaaagacagacactggaccaccagagagtttgaggagctaagatcatgtagagagtttgaagatcaaaagttaacaatgcttgaagctggctgtggggttggaaactgtttattcccacttttagaagaagatccgaatatctttgcctatgcctgtgatttttctccaagagccattgaatatgttaagcaaaatcctttatatgatacagaaagatgcaaggtattccagtgtgatctgactaaagatgatcttctggatcatgtaccgccagagtctgtggatgttgttatgttgatatttgtgctgtcagctgttcatcctgataagatgcaccttgtcttacaaaacatttacaagtgccatggctgctcttcagagcttcgccagccctgggacaaggatgattttgcagttacctgggatccatggagtcctgctataaggtattaaaaccaggcaaaagtgtcttgtttcgtgactacggactgtatgatcatgccatgcttaggtttaaagccagcagcaaacttggagaaaacttttatgttagacaagatgggaccagatcatatttttttactgatgacttcctggctcagctctttatggacacaggttatgaagaagtggtaaacgagtatgtgtttcgagagacggtgaataaaaaagaaggcctgtgtgtgccaagagttttccttcagagcaaatttctaaagcctcctaagaacccatctcctgtggtcctgggcctggatcctaagtcctgacctttcatgaggttggcatttataccttcccttgaagaggaaaatttaaaatcactctttcgtctgggtgcggtggctcatgcctgtaatcccagcacttcgggaggccgaggttgggggatcatctgaggtcaggagtttgagaccagcctggccaacatggtgagaccccatctctactaaaaatacaaaaaaattagctgggcatggtggcgagtgcctgtagtcccagctactcaggaggctgaggcaagagaatcgcttgaacccaagaggcggagactgcagtgagccaagatcatgccattgcactccagcctgggcgacagagtgagaccctgtttcataaataaataaaatcactctttttactttatatattttttgagacaggatcttgtggtacgcaggctggagtgcagtggtgtgtgatcacagctcattgtagcctcgacctcccctgggctcaggcagtcttcctgcctcagcctcctgagtagctaggactacaggtgtaagccaccatgcctggcccttaattttttttaatgagcatgtacagtagtcccgctttatccatggtttcacttaccacaatttcaattacctgttttcaactgcagtcagttacttttcttaagatattttgagggttataggctcatgcctataaccccagcactttgagaggccaaggccagcagatcccttgagcccaggagttcaagaccagtgtgggcaacatggtgaaactctgtctctacagaaaatacaaaaattagccaaatgtggtggcatgtgcctgtagtcccagctggggtgggaggttagcttgagcctggaaggtggaggttgcagtaagtcgagatcacgctactgcactccagcctgggcgacagagcaaaagtctgtctcaaaaaaaacaaaaaaaatttgaaagatcacattcacataacttttattacggtatattgttaaagttgttcttttttttttagagtttggtaccatcttggtttcaggcaaccactgggggtcttgaaacataccacccgcagatacggggggctactatgtactttttgtattaaaaaataggaagtgtatgtgtgtgtgttagagacatgtaaataaaatttcaaggcctgaaaagtagtcaaagttttatagaataacat

SEQ ID NO: 369011 - DNA, 4473 bp, Homo sapiens
  misc_feature (2518)..(2518): n is a, c, g, or t
  misc_feature (3105)..(3105): n is a, c, g, or t
  misc_feature (3166)..(3166): n is a, c, g, or t
  misc_feature (3179)..(3179): n is a, c, g, or t
  misc_feature (3246)..(3246): n is a, c, g, or t
  misc_feature (3315)..(3315): n is a, c, g, or t
  misc_feature (3418)..(3418): n is a, c, g, or t
  misc_feature (3551)..(3551): n is a, c, g, or t
  misc_feature (3555)..(3555): n is a, c, g, or t
  misc_feature (3998)..(3998): n is a, c, g, or t
gcggccgcttctcgaagctctccccgagcctcaggcaatgttcctcgcggtccagcagcgggtttgcggtcccattcatggccccgcacctgcctcgcacccagatcggcgctctcccggtgcagccgcgatccgagcttctggcgctggcgtctgggaggactgtgcttccgggccaccgctctggaagacaaggagagccgagccggcacccacccgggtccagaagcaagttctctcctctgcgtgggggtgagagaggaatctgaggaggcaaggccgtgggacttccggcgtcgggtaggaacttccgggttcctagcggaagtggcgggggcggtgccatggcaaaagaactcccggagaatccgaattcgtggtcctcagaattggtttagggttgtttcgcggttcttcccgtattctgcctccgaggcccagtggggctggctgtggggtgagtgcgcctggccctagccctgcagccccctgtgctgtttgaggcgtgaaactcacctcaggaaatgtatctgatccattagcgtggattcatattatttggtgatggagaatcttcagctgtgttaagtgttaccgtcagtttcagagatggcttctttgcaaaggaaagggctgcaggcaaggattctcacctctgaagaagaggagaaactgaaaagagaccaaactttggtgtctgattttaaacagcagaaattggaacaagaggctcagaaaaattgggatcttttttacaaaagaaatagcactaatttcttcaaagacagacactggaccaccagagagtttgaggagctaagatcatgtagagagtttgaagatcaaaagttaacaatgcttgaagctggctgtggggttggaaactgtttattcccacttttagaagaagatccgaatatctttgcctatgcctgtgatttttctccaagagccattgaatatgttaagcaaaatcctttatatgatacagaaagatgcaaggtattccagtgtgatctgactaaagatgatcttctggatcatgtaccgccagagtctgtggatgttgttatgttgatatttgtgctgtcagctgttcatcctgataagatgcaccttgtcttacaaaacatttacaagtgccatggctgctcttcagagcttcgccagccctgggacaaggatgattttgcagttacctgggatccatggagtcctgctataaggtattaaaaccaggcaaaagtgtcttgtttcgtgactacggactgtatgatcatgccatgcttaggtttaaagccagcagcaaacttggagaaaacttttatgttagacaagatgggaccagatcatatttttttactgatgacttcctggctcagctctttatggacacaggttatgaagaagtggtaaacgagtatgtgtttcgagagacggtgaataaaaaagaaggcctgtgtgtgccaagagttttccttcagagcaaatttctaaagcctcctaagaacccatctcctgtggtcctgggcctggatcctaagtcctgacctttcatgaggtctcaaacaaaagtctggaacctgggattcttgtaggatatctggctgtgctttgtattatatgaaccacagaaaataatcttccagtatgatattgttttcagtatagtacctcaaccctaatttgcctggtaaccctttatccagagacctttgttttcaacttacagtcttattctggggtgggggatgtacagtctggctgtgtggacttgcaggagagatttagggttctaacttcttcttactgacttccaaccaattctcctgtattcagtcttatacacacccccacttatactagacgtagctggtactaccaaagcctggtcacaaaactctatgggagtctcaatgcaagttgagttgcttcttgactttcatccctgctggcttaagactcagcttcacaagcctgctaagtcagttgctatttatcctgttttctagcccttcaaaattttaaatgaaaatttacatttttaattgacaaataatatatatatgggataaatatgatgttttgatagtaatagatgtatacattgtggaatgattatatgaagctaattagcatatcacactcctcacatacttctttttctttgtattgagaacatgtaaaatctattcttggccaagcatggtggctcacacctgtaattccaacactttgagaggccaaggcaggaagattgcttgagcccaggaattcaggggttccagacaccagcctgggcaacatagcaataccctgtctctaataaaaaaaaaaaaaagtaaaaataaatgtgtaatttaaaaaattcattattgttattatttttacaattttgaaactgtaggggccaggaacaaacttcccctttgccctctgaagaataactaaaaaatcactcaccaaatgcagattaataggagaaatggaataaaaacttagtaattgttttccttgntggatcccttaggtctttatgtagatagggaaaaggtttcttctagcatctgttgattgctaaggacatttaattcaaaatactcattataccagggagccatatctgggggtaaaattccagatgctccttcaaagtatacattattattgactatggtcaccatgtacagtagatctcaaaaacgtattccccctggctaactgaaatgtgtgccctttggtcaacatctcccctactcctctcctcccccagcctctggtaaccaccattctactttctgctgctgtgagttcaactttttaaaattccacgtataagtgaaatcatgtggtatttgtctttctgaatctggcttatttcacttagcataatatcttccaggttcacccatgttgttgcaaatgatagaatgtccttgtttctaatgttctcccaaatttaatcagttgtatggggtttatgtgataaaaatatccttttgctgtcattttcgtggggtttccagaaggatcctaactaggtacacatgcttagtctgtcttttttttttttttttttttgaagcaagtctccctctgttgccnggctggagtgcagtggcctgatcatgactcattgcaacctctgcctcccaggcccaagcantcctcctacctcngcctccaagtagctgggactgaaggtgtgtgccagcatgtgtggctaattttatttttgtaaagacngagtctccttatattgcccaggctggtctcaaactcctgggttcgagatcctcctgcctctgcctcccnaagtgctgggattacaggcatgagccatggtgcctggtctagtctgtcatctttaaacaattgggttgggaaggaaaaggtagcacatagatagatgatttangcagaaatagataagcataattgtccactgtaaaggggctgaatgatctggagaatggaggcatctcaggaaaactgaacttggtggtgtgtgcttaggactaatgaaaagtggccgggcacagatgctcatncctntaatcccagcacttcgggagggtgagagggagtataatttgaggccaggaattcaaggttgcagtgagccatgattgtgccactgttctccagcctgggcagcagagtgagaccccgactcttaaaaaaaaaaaaaaaagaaccaaagaaatgttagttccagggattcccagggacatgggcagggtccaagaatgatgctgagttaaggttaggtggctattcagaaagctacttcgacttgtatcccatattatggatcaaggaccttaaaaatagccatactttttttttgttctagtaactcaatttgtaggattgtttcctaagagataatctgacatattcaaggacttcttcacaaagatattcattagctgcattatttatagtaccaaacattataaatagtctaaaccagagatccacaagctatggctatnacagtgacaaggaggcctagcgtgactaactccattttgctcctaacccccctgcagcgataacctgtatcttttaggttaactgcttttgcttatctctgcacataggccaagctaactatagaaggaatttagtttatagtttagagcaaggatggtaatagtgcctcccccaaaactaacccctgaggagataaggaggatgtatgcaagtaataatgttatgttaaagatttataagagcactgtgacctgaccaaggacaaagtttcaccacctccttggacccttgccaccacccagatgtgatcactggccacttcttgacctcaactccctccctcttcccccttcctctcacgtaaaaggagcctgaaatttgtattgacttaaaaatggttcttcaggacactactcttccattttcttggtttgctggctctctgaataaaagtcactttccttgcctcaaccc

SEQ ID NO: 369012 - DNA, 3444 bp, Homo sapiens
  misc_feature (1489)..(1489): n is a, c, g, or t
  misc_feature (2076)..(2076): n is a, c, g, or t
  misc_feature (2137)..(2137): n is a, c, g, or t
  misc_feature (2150)..(2150): n is a, c, g, or t
  misc_feature (2217)..(2217): n is a, c, g, or t
  misc_feature (2286)..(2286): n is a, c, g, or t
  misc_feature (2389)..(2389): n is a, c, g, or t
  misc_feature (2522)..(2522): n is a, c, g, or t
  misc_feature (2526)..(2526): n is a, c, g, or t
  misc_feature (2969)..(2969): n is a, c, g, or t
aagaagtgtcttagtgttatggagccctgcctggtcttactatctttttaagtagtaggccattttggttccgtattatgggcatttcagtctgtccccttagtaactatcacaaatttattttaagtcctaacttaatcaggttttattttgacagggttctccaaagtcatgttcagcctgcttttgtttcataggtattaaaaccaggcaaaagtgtcttgtttcgtgactacggactgtatgatcatgccatgcttaggtttaaagccagcagcaaacttggagaaaacttttatgttagacaagatgggaccagatcatatttttttactgatgacttcctggctcagctctttatggacacaggttatgaagaagtggtaaacgagtatgtgtttcgagagacggtgaataaaaaagaaggcctgtgtgtgccaagagttttccttcagagcaaatttctaaagcctcctaagaacccatctcctgtggtcctgggcctggatcctaagtcctgacctttcatgaggtctcaaacaaaagtctggaacctgggattcttgtaggatatctggctgtgctttgtattatatgaaccacagaaaataatcttccagtatgatattgttttcagtatagtacctcaaccctaatttgcctggtaaccctttatccagagacctttgttttcaacttacagtcttattctggggtgggggatgtacagtctggctgtgtggacttgcaggagagatttagggttctaacttcttcttactgacttccaaccaattctcctgtattcagtcttatacacacccccacttatactagacgtagctggtactaccaaagcctggtcacaaaactctatgggagtctcaatgcaagttgagttgcttcttgactttcatccctgctggcttaagactcagcttcacaagcctgctaagtcagttgctatttatcctgttttctagcccttcaaaattttaaatgaaaatttacatttttaattgacaaataatatatatatgggataaatatgatgttttgatagtaatagatgtatacattgtggaatgattatatgaagctaattagcatatcacactcctcacatacttctttttctttgtattgagaacatgtaaaatctattcttggccaagcatggtggctcacacctgtaattccaacactttgagaggccaaggcaggaagattgcttgagcccaggaattcaggggttccagacaccagcctgggcaacatagcaataccctgtctctaataaaaaaaaaaaaaagtaaaaataaatgtgtaatttaaaaaattcattattgttattatttttacaattttgaaactgtaggggccaggaacaaacttcccctttgccctctgaagaataactaaaaaatcactcaccaaatgcagattaataggagaaatggaataaaaacttagtaattgttttccttgntggatcccttaggtctttatgtagatagggaaaaggtttcttctagcatctgttgattgctaaggacatttaattcaaaatactcattataccagggagccatatctgggggtaaaattccagatgctccttcaaagtatacattattattgactatggtcaccatgtacagtagatctcaaaaacgtattccccctggctaactgaaatgtgtgccctttggtcaacatctcccctactcctctcctcccccagcctctggtaaccaccattctactttctgctgctgtgagttcaactttttaaaattccacgtataagtgaaatcatgtggtatttgtctttctgaatctggcttatttcacttagcataatatcttccaggttcacccatgttgttgcaaatgatagaatgtccttgtttctaatgttctcccaaatttaatcagttgtatggggtttatgtgataaaaatatccttttgctgtcattttcgtggggtttccagaaggatcctaactaggtacacatgcttagtctgtcttttttttttttttttttttgaagcaagtctccctctgttgccnggctggagtgcagtggcctgatcatgactcattgcaacctctgcctcccaggcccaagcantcctcctacctcngcctccaagtagctgggactgaaggtgtgtgccagcatgtgtggctaattttatttttgtaaagacngagtctccttatattgcccaggctggtctcaaactcctgggttcgagatcctcctgcctctgcctcccnaagtgctgggattacaggcatgagccatggtgcctggtctagtctgtcatctttaaacaattgggttgggaaggaaaaggtagcacatagatagatgatttangcagaaatagataagcataattgtccactgtaaaggggctgaatgatctggagaatggaggcatctcaggaaaactgaacttggtggtgtgtgcttaggactaatgaaaagtggccgggcacagatgctcatncctntaatcccagcacttcgggagggtgagagggagtataatttgaggccaggaattcaaggttgcagtgagccatgattgtgccactgttctccagcctgggcagcagagtgagaccccgactcttaaaaaaaaaaaaaaaagaaccaaagaaatgttagttccagggattcccagggacatgggcagggtccaagaatgatgctgagttaaggttaggtggctattcagaaagctacttcgacttgtatcccatattatggatcaaggaccttaaaaatagccatactttttttttgttctagtaactcaatttgtaggattgtttcctaagagataatctgacatattcaaggacttcttcacaaagatattcattagctgcattatttatagtaccaaacattataaatagtctaaaccagagatccacaagctatggctatnacagtgacaaggaggcctagcgtgactaactccattttgctcctaacccccctgcagcgataacctgtatcttttaggttaactgcttttgcttatctctgcacataggccaagctaactatagaaggaatttagtttatagtttagagcaaggatggtaatagtgcctcccccaaaactaacccctgaggagataaggaggatgtatgcaagtaataatgttatgttaaagatttataagagcactgtgacctgaccaaggacaaagtttcaccacctccttggacccttgccaccacccagatgtgatcactggccacttcttgacctcaactccctccctcttcccccttcctctcacgtaaaaggagcctgaaatttgtattgacttaaaaatggttcttcaggacactactcttccattttcttggtttgctggctctctgaataaaagtcactttccttgcctcaaccc

SEQ ID NO: 369013 - DNA, 2500 bp, Homo sapiens
gcggccgcttctcgaagctctccccgagcctcaggcaatgttcctcgcggtccagcagcgggtttgcggtcccattcatggccccgcacctgcctcgcacccagatcggcgctctcccggtgcagccgcgatccgagcttctggcgctggcgtctgggaggactgtgcttccgggccaccgctctggaagacaaggagagccgagccggcacccacccgggtccagaagcaagttctctcctctgcgtgggggtgagagaggaatctgaggaggcaaggccgtgggacttccggcgtcgggtaggaacttccgggttcctagcggaagtggcgggggcggtgccatggcaaaagaactcccggagaatccgaattcgtggtcctcagaattggtttagggttgtttcgcggttcttcccgtattctgcctccgaggcccagtggggctggctgtggggtgagtgcgcctggccctagccctgcagccccctgtgctgtttgaggcgtgaaactcacctcaggaaatgtatctgatccattagcgtggattcatattatttggtgatggagaatcttcagctgtgttaagtgttaccgtcagtttcagagatggcttctttgcaaaggaaagggctgcaggcaaggattctcacctctgaagaagaggagaaactgaaaagagaccaaactttggtgtctgattttaaacagcagaaattggaacaagaggctcagaaaaattgggatcttttttacaaaagaaatagcactaatttcttcaaagacagacactggaccaccagagagtttgaggagctaagatcatgtagagagtttgaagatcaaaagttaacaatgcttgaagctggctgtggggttggaaactgtttattcccacttttagaagaagatccgaatatctttgcctatgcctgtgatttttctccaagagccattgaatatgttaagcaaaatcctttatatgatacagaaagatgcaaggtattccagtgtgatctgactaaagatgatcttctggatcatgtaccgccagagtctgtggatgttgttatgttgatatttgtgctgtcagctgttcatcctgataagatgcaccttgtcttacaaaacatttacaagacttcctggctcagctctttatggacacaggttatgaagaagtggtaaacgagtatgtgtttcgagagacggtgaataaaaaagaaggcctgtgtgtgccaagagttttccttcagagcaaatttctaaagcctcctaagaacccatctcctgtggtcctgggcctggatcctaagtcctgacctttcatgaggttggcatttataccttcccttgaagaggaaaatttaaaatcactctttcgtctgggtgcggtggctcatgcctgtaatcccagcacttcgggaggccgaggttgggggatcatctgaggtcaggagtttgagaccagcctggccaacatggtgagaccccatctctactaaaaatacaaaaaaattagctgggcatggtggcgagtgcctgtagtcccagctactcaggaggctgaggcaagagaatcgcttgaacccaagaggcggagactgcagtgagccaagatcatgccattgcactccagcctgggcgacagagtgagaccctgtttcataaataaataaaatcactctttttactttatatattttttgagacaggatcttgtggtacgcaggctggagtgcagtggtgtgtgatcacagctcattgtagcctcgacctcccctgggctcaggcagtcttcctgcctcagcctcctgagtagctaggactacaggtgtaagccaccatgcctggcccttaattttttttaatgagcatgtacagtagtcccgctttatccatggtttcacttaccacaatttcaattacctgttttcaactgcagtcagttacttttcttaagatattttgagggttataggctcatgcctataaccccagcactttgagaggccaaggccagcagatcccttgagcccaggagttcaagaccagtgtgggcaacatggtgaaactctgtctctacagaaaatacaaaaattagccaaatgtggtggcatgtgcctgtagtcccagctggggtgggaggttagcttgagcctggaaggtggaggttgcagtaagtcgagatcacgctactgcactccagcctgggcgacagagcaaaagtctgtctcaaaaaaaacaaaaaaaatttgaaagatcacattcacataacttttattacggtatattgttaaagttgttcttttttttttagagtttggtaccatcttggtttcaggcaaccactgggggtcttgaaacataccacccgcagatacggggggctactatgtactttttgtattaaaaaataggaagtgtatgtgtgtgtgttagagacatgtaaataaaatttcaaggcctgaaaagtagtcaaagttttatagaataacat

SEQ ID NO: 369014 - DNA, 386 bp, Homo sapiens
agatgggaccagatcatatttttttactgatggtaagatgaatggaatccagtctttaaatgttttattctttgtttctgtttatttgattgcattatcactgcaaggctgcttggagaaggcttgcgacatgtgcacgagaccctgaaacaagccctctactgcacaatatttacccagcacctggaaggcacagacctggcccctgcccttgaagagctcacaagccttctctggtgtcagtgactcccctaatgagcttgggttaatggacagcctctgacatgccatgtggattccctactaggaattgtgctggaataagagggagggcaagtcagaaacttcttgtccagttaaaaataaagcaaatttgacagtataat

SEQ ID NO: 369015 - DNA, 4409 bp, Homo sapiens
  misc_feature (2454)..(2454): n is a, c, g, or t
  misc_feature (3041)..(3041): n is a, c, g, or t
  misc_feature (3102)..(3102): n is a, c, g, or t
  misc_feature (3115)..(3115): n is a, c, g, or t
  misc_feature (3182)..(3182): n is a, c, g, or t
  misc_feature (3251)..(3251): n is a, c, g, or t
  misc_feature (3354)..(3354): n is a, c, g, or t
  misc_feature (3487)..(3487): n is a, c, g, or t
  misc_feature (3491)..(3491): n is a, c, g, or t
  misc_feature (3934)..(3934): n is a, c, g, or t
gcggccgcttctcgaagctctccccgagcctcaggcaatgttcctcgcggtccagcagcgggtttgcggtcccattcatggccccgcacctgcctcgcacccagatcggcgctctcccggtgcagccgcgatccgagcttctggcgctggcgtctgggaggactgtgcttccgggccaccgctctggaagacaaggagagccgagccggcacccacccgggtccagaagcaagttctctcctctgcgtgggggtgagagaggaatctgaggaggcaaggccgtgggacttccggcgtcgggtaggaacttccgggttcctagcggaagtggcgggggcggtgccatggcaaaagaactcccggagaatccgaattcgtggtcctcagaattggtttagggttgtttcgcggttcttcccgtattctgcctccgaggcccagtggggctggctgtgggccccctgtgctgtttgaggcgtgaaactcacctcaggaaatgtatctgatccattagcgtggattcatattatttggtgatggagaatcttcagctgtgttaagtgttaccgtcagtttcagagatggcttctttgcaaaggaaagggctgcaggcaaggattctcacctctgaagaagaggagaaactgaaaagagaccaaactttggtgtctgattttaaacagcagaaattggaacaagaggctcagaaaaattgggatcttttttacaaaagaaatagcactaatttcttcaaagacagacactggaccaccagagagtttgaggagctaagatcatgtagagagtttgaagatcaaaagttaacaatgcttgaagctggctgtggggttggaaactgtttattcccacttttagaagaagatccgaatatctttgcctatgcctgtgatttttctccaagagccattgaatatgttaagcaaaatcctttatatgatacagaaagatgcaaggtattccagtgtgatctgactaaagatgatcttctggatcatgtaccgccagagtctgtggatgttgttatgttgatatttgtgctgtcagctgttcatcctgataagatgcaccttgtcttacaaaacatttacaagtgccatggctgctcttcagagcttcgccagccctgggacaaggatgattttgcagttacctgggatccatggagtcctgctataagtacggactgtatgatcatgccatgcttaggtttaaagccagcagcaaacttggagaaaacttttatgttagacaagatgggaccagatcatatttttttactgatgacttcctggctcagctctttatggacacaggttatgaagaagtggtaaacgagtatgtgtttcgagagacggtgaataaaaaagaaggcctgtgtgtgccaagagttttccttcagagcaaatttctaaagcctcctaagaacccatctcctgtggtcctgggcctggatcctaagtcctgacctttcatgaggtctcaaacaaaagtctggaacctgggattcttgtaggatatctggctgtgctttgtattatatgaaccacagaaaataatcttccagtatgatattgttttcagtatagtacctcaaccctaatttgcctggtaaccctttatccagagacctttgttttcaacttacagtcttattctggggtgggggatgtacagtctggctgtgtggacttgcaggagagatttagggttctaacttcttcttactgacttccaaccaattctcctgtattcagtcttatacacacccccacttatactagacgtagctggtactaccaaagcctggtcacaaaactctatgggagtctcaatgcaagttgagttgcttcttgactttcatccctgctggcttaagactcagcttcacaagcctgctaagtcagttgctatttatcctgttttctagcccttcaaaattttaaatgaaaatttacatttttaattgacaaataatatatatatgggataaatatgatgttttgatagtaatagatgtatacattgtggaatgattatatgaagctaattagcatatcacactcctcacatacttctttttctttgtattgagaacatgtaaaatctattcttggccaagcatggtggctcacacctgtaattccaacactttgagaggccaaggcaggaagattgcttgagcccaggaattcaggggttccagacaccagcctgggcaacatagcaataccctgtctctaataaaaaaaaaaaaaagtaaaaataaatgtgtaatttaaaaaattcattattgttattatttttacaattttgaaactgtaggggccaggaacaaacttcccctttgccctctgaagaataactaaaaaatcactcaccaaatgcagattaataggagaaatggaataaaaacttagtaattgttttccttgntggatcccttaggtctttatgtagatagggaaaaggtttcttctagcatctgttgattgctaaggacatttaattcaaaatactcattataccagggagccatatctgggggtaaaattccagatgctccttcaaagtatacattattattgactatggtcaccatgtacagtagatctcaaaaacgtattccccctggctaactgaaatgtgtgccctttggtcaacatctcccctactcctctcctcccccagcctctggtaaccaccattctactttctgctgctgtgagttcaactttttaaaattccacgtataagtgaaatcatgtggtatttgtctttctgaatctggcttatttcacttagcataatatcttccaggttcacccatgttgttgcaaatgatagaatgtccttgtttctaatgttctcccaaatttaatcagttgtatggggtttatgtgataaaaatatccttttgctgtcattttcgtggggtttccagaaggatcctaactaggtacacatgcttagtctgtcttttttttttttttttttttgaagcaagtctccctctgttgccnggctggagtgcagtggcctgatcatgactcattgcaacctctgcctcccaggcccaagcantcctcctacctcngcctccaagtagctgggactgaaggtgtgtgccagcatgtgtggctaattttatttttgtaaagacngagtctccttatattgcccaggctggtctcaaactcctgggttcgagatcctcctgcctctgcctcccnaagtgctgggattacaggcatgagccatggtgcctggtctagtctgtcatctttaaacaattgggttgggaaggaaaaggtagcacatagatagatgatttangcagaaatagataagcataattgtccactgtaaaggggctgaatgatctggagaatggaggcatctcaggaaaactgaacttggtggtgtgtgcttaggactaatgaaaagtggccgggcacagatgctcatncctntaatcccagcacttcgggagggtgagagggagtataatttgaggccaggaattcaaggttgcagtgagccatgattgtgccactgttctccagcctgggcagcagagtgagaccccgactcttaaaaaaaaaaaaaaaagaaccaaagaaatgttagttccagggattcccagggacatgggcagggtccaagaatgatgctgagttaaggttaggtggctattcagaaagctacttcgacttgtatcccatattatggatcaaggaccttaaaaatagccatactttttttttgttctagtaactcaatttgtaggattgtttcctaagagataatctgacatattcaaggacttcttcacaaagatattcattagctgcattatttatagtaccaaacattataaatagtctaaaccagagatccacaagctatggctatnacagtgacaaggaggcctagcgtgactaactccattttgctcctaacccccctgcagcgataacctgtatcttttaggttaactgcttttgcttatctctgcacataggccaagctaactatagaaggaatttagtttatagtttagagcaaggatggtaatagtgcctcccccaaaactaacccctgaggagataaggaggatgtatgcaagtaataatgttatgttaaagatttataagagcactgtgacctgaccaaggacaaagtttcaccacctccttggacccttgccaccacccagatgtgatcactggccacttcttgacctcaactccctccctcttcccccttcctctcacgtaaaaggagcctgaaatttgtattgacttaaaaatggttcttcaggacactactcttccattttcttggtttgctggctctctgaataaaagtcactttccttgcctcaaccc

SEQ ID NO: 369016 - DNA, 2614 bp, Homo sapiens
gcggccgcttctcgaagctctccccgagcctcaggcaatgttcctcgcggtccagcagcgggtttgcggtcccattcatggccccgcacctgcctcgcacccagatcggcgctctcccggtgcagccgcgatccgagcttctggcgctggcgtctgggaggactgtgcttccgggccaccgctctggaagacaaggagagccgagccggcacccacccgggtccagaagcaagttctctcctctgcgtgggggtgagagaggaatctgaggaggcaaggccgtgggacttccggcgtcgggtaggaacttccgggttcctagcggaagtggcgggggcggtgccatggcaaaagaactcccggagaatccgaattcgtggtcctcagaattggtttagggttgtttcgcggttcttcccgtattctgcctccgaggcccagtggggctggctgtgggccccctgtgctgtttgaggcgtgaaactcacctcaggaaatgtatctgatccattagcgtggattcatattatttggtgatggagaatcttcagctgtgttaagtgttaccgtcagtttcagagatggcttctttgcaaaggaaagggctgcaggcaaggattctcacctctgaagaagaggagaaactgaaaagagaccaaactttggtgtctgattttaaacagcagaaattggaacaagaggctcagaaaaattgggatcttttttacaaaagaaatagcactaatttcttcaaagacagacactggaccaccagagagtttgaggagctaagatcatgtagagagtttgaagatcaaaagttaacaatgcttgaagctggctgtggggttggaaactgtttattcccacttttagaagaagatccgaatatctttgcctatgcctgtgatttttctccaagagccattgaatatgttaagcaaaatcctttatatgatacagaaagatgcaaggtattccagtgtgatctgactaaagatgatcttctggatcatgtaccgccagagtctgtggatgttgttatgttgatatttgtgctgtcagctgttcatcctgataagatgcaccttgtcttacaaaacatttacaaggtattaaaaccaggcaaaagtgtcttgtttcgtgactacggactgtatgatcatgccatgcttaggtttaaagccagcagcaaacttggagaaaacttttatgttagacaagatgggaccagatcatatttttttactgatgacttcctggctcagctctttatggacacaggttatgaagaagtggtaaacgagtatgtgtttcgagagacggtgaataaaaaagaaggcctgtgtgtgccaagagttttccttcagagcaaatttctaaagcctcctaagaacccatctcctgtggtcctgggcctggatcctaagtcctgacctttcatgaggttggcatttataccttcccttgaagaggaaaatttaaaatcactctttcgtctgggtgcggtggctcatgcctgtaatcccagcacttcgggaggccgaggttgggggatcatctgaggtcaggagtttgagaccagcctggccaacatggtgagaccccatctctactaaaaatacaaaaaaattagctgggcatggtggcgagtgcctgtagtcccagctactcaggaggctgaggcaagagaatcgcttgaacccaagaggcggagactgcagtgagccaagatcatgccattgcactccagcctgggcgacagagtgagaccctgtttcataaataaataaaatcactctttttactttatatattttttgagacaggatcttgtggtacgcaggctggagtgcagtggtgtgtgatcacagctcattgtagcctcgacctcccctgggctcaggcagtcttcctgcctcagcctcctgagtagctaggactacaggtgtaagccaccatgcctggcccttaattttttttaatgagcatgtacagtagtcccgctttatccatggtttcacttaccacaatttcaattacctgttttcaactgcagtcagttacttttcttaagatattttgagggttataggctcatgcctataaccccagcactttgagaggccaaggccagcagatcccttgagcccaggagttcaagaccagtgtgggcaacatggtgaaactctgtctctacagaaaatacaaaaattagccaaatgtggtggcatgtgcctgtagtcccagctggggtgggaggttagcttgagcctggaaggtggaggttgcagtaagtcgagatcacgctactgcactccagcctgggcgacagagcaaaagtctgtctcaaaaaaaacaaaaaaaatttgaaagatcacattcacataacttttattacggtatattgttaaagttgttcttttttttttagagtttggtaccatcttggtttcaggcaaccactgggggtcttgaaacataccacccgcagatacggggggctactatgtactttttgtattaaaaaataggaagtgtatgtgtgtgtgttagagacatgtaaataaaatttcaaggcctgaaaagtagtcaaagttttatagaataacat

SEQ ID NO: 369017 - DNA, 4240 bp, Homo sapiens
  misc_feature (2285)..(2285): n is a, c, g, or t
  misc_feature (2872)..(2872): n is a, c, g, or t
  misc_feature (2933)..(2933): n is a, c, g, or t
  misc_feature (2946)..(2946): n is a, c, g, or t
  misc_feature (3013)..(3013): n is a, c, g, or t
  misc_feature (3082)..(3082): n is a, c, g, or t
  misc_feature (3185)..(3185): n is a, c, g, or t
  misc_feature (3318)..(3318): n is a, c, g, or t
  misc_feature (3322)..(3322): n is a, c, g, or t
  misc_feature (3765)..(3765): n is a, c, g, or t
gcggccgcttctcgaagctctccccgagcctcaggcaatgttcctcgcggtccagcagcgggtttgcggtcccattcatggccccgcacctgcctcgcacccagatcggcgctctcccggtgcagccgcgatccgagcttctggcgctggcgtctgggaggactgtgcttccgggccaccgctctggaagacaaggagagccgagccggcacccacccgggtccagaagcaagttctctcctctgcgtggggccccctgtgctgtttgaggcgtgaaactcacctcaggaaatgtatctgatccattagcgtggattcatattatttggtgatggagaatcttcagctgtgttaagtgttaccgtcagtttcagagatggcttctttgcaaaggaaagggctgcaggcaaggattctcacctctgaagaagaggagaaactgaaaagagaccaaactttggtgtctgattttaaacagcagaaattggaacaagaggctcagaaaaattgggatcttttttacaaaagaaatagcactaatttcttcaaagacagacactggaccaccagagagtttgaggagctaagatcatgtagagagtttgaagatcaaaagttaacaatgcttgaagctggctgtggggttggaaactgtttattcccacttttagaagaagatccgaatatctttgcctatgcctgtgatttttctccaagagccattgaatatgttaagcaaaatcctttatatgatacagaaagatgcaaggtattccagtgtgatctgactaaagatgatcttctggatcatgtaccgccagagtctgtggatgttgttatgttgatatttgtgctgtcagctgttcatcctgataagatgcaccttgtcttacaaaacatttacaagtgccatggctgctcttcagagcttcgccagccctgggacaaggatgattttgcagttacctgggatccatggagtcctgctataaggtattaaaaccaggcaaaagtgtcttgtttcgtgactacggactgtatgatcatgccatgcttaggtttaaagccagcagcaaacttggagaaaacttttatgttagacaagatgggaccagatcatatttttttactgatgacttcctggctcagctctttatggacacaggttatgaagaagtggtaaacgagtatgtgtttcgagagacggtgaataaaaaagaaggcctgtgtgtgccaagagttttccttcagagcaaatttctaaagcctcctaagaacccatctcctgtggtcctgggcctggatcctaagtcctgacctttcatgaggtctcaaacaaaagtctggaacctgggattcttgtaggatatctggctgtgctttgtattatatgaaccacagaaaataatcttccagtatgatattgttttcagtatagtacctcaaccctaatttgcctggtaaccctttatccagagacctttgttttcaacttacagtcttattctggggtgggggatgtacagtctggctgtgtggacttgcaggagagatttagggttctaacttcttcttactgacttccaaccaattctcctgtattcagtcttatacacacccccacttatactagacgtagctggtactaccaaagcctggtcacaaaactctatgggagtctcaatgcaagttgagttgcttcttgactttcatccctgctggcttaagactcagcttcacaagcctgctaagtcagttgctatttatcctgttttctagcccttcaaaattttaaatgaaaatttacatttttaattgacaaataatatatatatgggataaatatgatgttttgatagtaatagatgtatacattgtggaatgattatatgaagctaattagcatatcacactcctcacatacttctttttctttgtattgagaacatgtaaaatctattcttggccaagcatggtggctcacacctgtaattccaacactttgagaggccaaggcaggaagattgcttgagcccaggaattcaggggttccagacaccagcctgggcaacatagcaataccctgtctctaataaaaaaaaaaaaaagtaaaaataaatgtgtaatttaaaaaattcattattgttattatttttacaattttgaaactgtaggggccaggaacaaacttcccctttgccctctgaagaataactaaaaaatcactcaccaaatgcagattaataggagaaatggaataaaaacttagtaattgttttccttgntggatcccttaggtctttatgtagatagggaaaaggtttcttctagcatctgttgattgctaaggacatttaattcaaaatactcattataccagggagccatatctgggggtaaaattccagatgctccttcaaagtatacattattattgactatggtcaccatgtacagtagatctcaaaaacgtattccccctggctaactgaaatgtgtgccctttggtcaacatctcccctactcctctcctcccccagcctctggtaaccaccattctactttctgctgctgtgagttcaactttttaaaattccacgtataagtgaaatcatgtggtatttgtctttctgaatctggcttatttcacttagcataatatcttccaggttcacccatgttgttgcaaatgatagaatgtccttgtttctaatgttctcccaaatttaatcagttgtatggggtttatgtgataaaaatatccttttgctgtcattttcgtggggtttccagaaggatcctaactaggtacacatgcttagtctgtcttttttttttttttttttttgaagcaagtctccctctgttgccnggctggagtgcagtggcctgatcatgactcattgcaacctctgcctcccaggcccaagcantcctcctacctcngcctccaagtagctgggactgaaggtgtgtgccagcatgtgtggctaattttatttttgtaaagacngagtctccttatattgcccaggctggtctcaaactcctgggttcgagatcctcctgcctctgcctcccnaagtgctgggattacaggcatgagccatggtgcctggtctagtctgtcatctttaaacaattgggttgggaaggaaaaggtagcacatagatagatgatttangcagaaatagataagcataattgtccactgtaaaggggctgaatgatctggagaatggaggcatctcaggaaaactgaacttggtggtgtgtgcttaggactaatgaaaagtggccgggcacagatgctcatncctntaatcccagcacttcgggagggtgagagggagtataatttgaggccaggaattcaaggttgcagtgagccatgattgtgccactgttctccagcctgggcagcagagtgagaccccgactcttaaaaaaaaaaaaaaaagaaccaaagaaatgttagttccagggattcccagggacatgggcagggtccaagaatgatgctgagttaaggttaggtggctattcagaaagctacttcgacttgtatcccatattatggatcaaggaccttaaaaatagccatactttttttttgttctagtaactcaatttgtaggattgtttcctaagagataatctgacatattcaaggacttcttcacaaagatattcattagctgcattatttatagtaccaaacattataaatagtctaaaccagagatccacaagctatggctatnacagtgacaaggaggcctagcgtgactaactccattttgctcctaacccccctgcagcgataacctgtatcttttaggttaactgcttttgcttatctctgcacataggccaagctaactatagaaggaatttagtttatagtttagagcaaggatggtaatagtgcctcccccaaaactaacccctgaggagataaggaggatgtatgcaagtaataatgttatgttaaagatttataagagcactgtgacctgaccaaggacaaagtttcaccacctccttggacccttgccaccacccagatgtgatcactggccacttcttgacctcaactccctccctcttcccccttcctctcacgtaaaaggagcctgaaatttgtattgacttaaaaatggttcttcaggacactactcttccattttcttggtttgctggctctctgaataaaagtcactttccttgcctcaaccc

SEQ ID NO: 369018 - DNA, 1473 bp, Homo sapiens
gcggccgcttctcgaagctctccccgagcctcaggcaatgttcctcgcggtccagcagcgggtttgcggtcccattcatggccccgcacctgcctcgcacccagatcggcgctctcccggtgcagccgcgatccgagcttctggcgctggcgtctgggaggactgtgcttccgggccaccgctctggaagacaaggagagccgagccggcacccacccgggtccagaagcaagttctctcctctgcgtgggggtgagagaggaatctgaggaggcaaggccgtgggacttccggcgtcgggtaggaacttccgggttcctagcggaagtggcgggggcggtgccatggcaaaagaactcccggagaatccgaattcgtggtcctcagaattggtttagggttgtttcgcggttcttcccgtattctgcctccgaggcccagtggggctggctgtgggccccctgtgctgtttgaggcgtgaaactcacctcaggaaatgtatctgatccattagcgtggattcatattatttggtgatggagaatcttcagctgtgttaagtgttaccgtcagtttcagagatggcttctttgcaaaggaaagggctgcaggcaaggattctcacctctgaagaagaggagaaactgaaaagagaccaaactttggtgtctgattttaaacagcagaaattggaacaagaggctcagaaaaattgggatcttttttacaaaagaaatagcactaatttcttcaaagacagacactggaccaccagagagtttgaggagctaagatcatgtagagagtttgaagatcaaaagttaacaatgcttgaagctggctgtggggttggaaactgtttattcccacttttagaagaagatccgaatatctttgcctatgcctgtgatttttctccaagagccattgaatatgttaagcaaaatcctttatatgatacagaaagatgcaaggtattccagtgtgatctgactaaagatgatcttctggatcatgtaccgccagagtctgtggatgttgttatgttgatatttgtgctgtcagctgttcatcctgataagatgcaccttgtcttacaaaacatttacaagtgccatggctgctcttcagagcttcgccagccctgggacaaggatgattttgcagttacctgggatccatggagtcctgctataaggctgcttggagaaggcttgcgacatgtgcacgagaccctgaaacaagccctctactgcacaatatttacccagcacctggaaggcacagacctggcccctgcccttgaagagctcacaagccttctctggtgtcagtgactcccctaatgagcttgggttaatggacagcctctgacatgccatgtggattccctactaggaattgtgctggaataagagggagggcaagtcagaaacttcttgtccagttaaaaataaagcaaatttgacagta

SEQ ID NO: 369019 - DNA, 526 bp, Homo sapiens
cgtcgacagaagacgacagaagggagcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacaca

SEQ ID NO: 369020 - DNA, 960 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagcgggaacatgcctgagcagaagggtgtcatggcggagcacggtcccacttgcatggtgcttcacccgttggctggaagtccctctaagaccaaacttacgtggctactcagcatcgacctcaaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgttgggggtcagattaggtatcattattcacccaac

SEQ ID NO: 369021 - DNA, 473 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagcaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacaca

SEQ ID NO: 369022 - DNA, 2720 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggccacagacttcgggaacatgcctgagcagaagggtgtcatcagggcggagcacggtcccacttgcatggtgcttcacccgttggctggaagtccctctaagaccaaacttacgtggctactcagcatcgacctcaaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacacaaaacatcagtctttgttttaatattgtactgttaaaaaaatctatgcagctgggtgcagtggctcacgcctgtaatcccagcattttgggaggctgaggtaggcggatcacaaggtcaggagatcgagaccatcctggccaacatggtgaaaccccgtctctactaaaatacaaaaaattagctgggtgtggtggcgcaaacctgtagtcgtagctacttgggaggctgaggcaggggaatcacttgaaccccggaggcggaggttgtagtgggccgagattgtgccactgcgctccagcgtgggcgacagagtgagactccatctcaaaaaaaaaaaaaaaaaatctatgctagtagattacaacttcacactagaggagttctggacaaagcttttaattagtcaaactaaattaaggctcattaaaaggaaaggaactactgggaaattatgcaattcaataatttagactctgttaccaggatctttcataaaaatttaatttccataatcataacctaaatgagttcttaaagaattctataagcaatagctgattaatgggccctggaagatgaagattataactgtttatttacctaattaaaaggaaaggcagtgccaaatatgagaggataaacaatattagttaacatttctgttatttatgatgccaattagtagtaagataattccacagctgtcaactttgtttggggctggcaacttctctgcttaaacaggctaaaagtttagtattctgggagaagtggctggaagaaggggtaatatggtgaaagcaaattccctttcccaggagtcaagagaatttatgtgaggtggcttcccgcctgtaatctcagcactttgggagggccaggcaggcaatcacctgaggccaggagaccagcctgactaacatggagaaaccccatctctactaaaaatacaaaatgagctgggcgt

SEQ ID NO: 369023 - DNA, 2776 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
  misc_feature (2610)..(2611): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggccacagacttcgggaacatgcctgagcagaagggtgtcatcagggcggagcacggtcccacttgcatggtgcttcacccgttggctggaagtccctctaagaccaaacttacgtggctactcagcatcgacctcaaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacacaaaacatcagtctttgttttaatattgtactgttaaaaaaatctatgcagctgggtgcagtggctcacgcctgtaatcccagcattttgggaggctgaggtaggcggatcacaaggtcaggagatcgagaccatcctggccaacatggtgaaaccccgtctctactaaaatacaaaaaattagctgggtgtggtggcgcaaacctgtagtcgtagctacttgggaggctgaggcaggggaatcacttgaaccccggaggcggaggttgtagtgggccgagattgtgccactgcgctccagcgtgggcgacagagtgagactccatctcaaaaaaaaaaaaaaaaaatctatgctagtagattacaacttcacactagaggagttctggacaaagcttttaattagtcaaactaaattaaggctcattaaaaggaaaggaactactgggaaattatgcaattcaataatttagactctgttaccaggatctttcataaaaatttaatttccataatcataacctaaatgagttcttaaagaattctataagcaatagctgattaatgggccctggaagatgaagattataactgtttatttacctaattaaaaggaaaggcagtgccaaatatgagaggataaacaatattagttaacatttctgttatttatgatgccaattagtagtaagataattccacagctgtcaactttgtttggggctggcaacttctctgcttaaacaggctaaaagtttagtattctgggagaagtggctggaagaaggggtaatatggtgaaagcaaattccctttcccaggagtcaagagaatttatgtgaggtgtaaaagtttagtanntgggagaagtggctggaagaaggggtaatatggtgaaagcaaattccctttccaggagtcaagagattagtggctccgctgtatctcagcacttggagcagcagcatcgactagcgagcagctgactactgagagccatcttctaatcatgctgctgtgtctctt

SEQ ID NO: 369024 - DNA, 1842 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggccacagacttcgggaacatgcctgagcagaagggtgtcatcagggcggagcacggtcccacttgcatggtgcttcacccgttggctggaagtccctctaagaccaaacttacgtggctactcagcatcgacctcaaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacacaaaaaaaaactcgagggggggccggtaccccatttggcctatagtgagtcgattaccaattaatggccgtggtttacaactcgtgactggg

SEQ ID NO: 369025 - DNA, 1705 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggccacagacttcgggaacatgcctgagcagaagggtgtcatcagggcggagcacggtcccacttgcatggtgcttcacccgttggctggaagtccctctaagaccaaacttacgtggctactcagcatcgacctcaaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggtttaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacaca

SEQ ID NO: 369026 - DNA, 1692 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggccacagacttcgggaacatgcctgagcagaagggtgtcatcagggcggagcacggtcccacttgcatggtgcttcacccgttggctggaagtccctctaagaccaaacttacgtggctactcagcatcgacctcaaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacaca

SEQ ID NO: 369027 - DNA, 1744 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggccacagacttcgggaacatgcctgagcagaagggtgtcatcagggcggagcacggtcccacttgcatggtgcttcacccgttggctggaagtccctctaagaccaaacttacgtggctactcagcatcgacctcaaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtcacaataacggtcataatttacacgtgtttgactaaatttgcatgtataaacctttgtcggacgctcgtgccctcc

SEQ ID NO: 369028 - DNA, 1613 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggccacagacttcgggaacatgcctgagcagaagggtgtcatcagggcggagcacggtcccacttgcatggtgcttcacccgttggctggaagtccctctaagaccaaacttacgtggctactcagcatcgacctcaaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaacagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacaca

SEQ ID NO: 369029 - DNA, 1606 bp, Homo sapiens
gacctgtttacgtccgacagaacgaggggacgtaacggaggcaggttggagccgctgccgtcgccatgacccgcggtaaccagcgtgagctcgcccgccagaagaatatgaagttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggccacagacttcgggaacatgcctgagcagaagggtgtcatcagggcggagcacggtcccacttgcatggtgcttcacccgttggctggaagtccctctaagaccaaacttacgtggctactcagcatcgacctcaaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacaca

SEQ ID NO: 369030 - DNA, 1695 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggcaggaaacctggtggggccccgtgactttgtgagcgtgcgctgtgccaagcgccgaggctccacctgtgtgctggctggcatggccacagacttcgggaacatgcctgagcagaagggtgtcatcagggcggagcacggtcccacttgcatggtgcttcacccgttggctggaagtccctctaagaccaaacttacgtggctactcagcatcgacctcaaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacaca

SEQ ID NO: 369031 - DNA, 1705 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggccacagacttcgggaacatgcctgagcagaagggtgtcatcagggcggagcacggtcccacttgcatggtgcttcacccgttggctggaagtccctctaagaccaaacttacgtggctactcagcatcgacctcaaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacaca

SEQ ID NO: 369032 - DNA, 1696 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcaaggctccacctgtgtgctggctggcatggccacagacttcgggaacatgcctgagcagaagggtgtcatcagggcggagcacggtcccacttgcatggtgcttcacccgttggctggaagtccctctaagaccaaacttacgtggctactcagcatcgacctcaaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacaca

SEQ ID NO: 369033 - DNA, 1236 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagcgctctatgaagagctcgtggagcgcatggaagcaatgggggagtggaaccccaatgtcaaggagatcaaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggccacagacttcgggaacatgcctgagcagaagggtgtcatcagggcggagcacggtcccacttgcatggtgcttcacccgttggctggaagtccctctaagaccaaacttacgtggctactcagcatcgacctcaaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacaca

SEQ ID NO: 369034 - DNA, 1428 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggagggaagtccctctaagaccaaacttacgtggctactcagcatcgacctcaaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacaca

SEQ ID NO: 369035 - DNA, 896 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacaca

SEQ ID NO: 369036 - DNA, 1042 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacaca

SEQ ID NO: 369037 - DNA, 991 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
  misc_feature (902)..(902): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcaaggctccacctgtgtgctggctggcatggccacagacttcgggaacatgcctgagcagaagggtgtcatcagtggcaatagggcggagcacggtccacttgcatgggngcttaacccgtgggttgaagtccctttaagacaacctacggggaattaacatttgccctaaggggtggttggcaagaacataataaact

SEQ ID NO: 369038 - DNA, 1494 bp, Homo sapiens
cgtcgacagaagacgacagaagggagcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacacaaaacatcagtctttgttttaatattgtactgttaaaaaaatctatgcagctgggtgcagtggctcacgcctgtaatcccagcattttgggaggctgaggtaggcggatcacaaggtcaggagatcgagaccatcctggccaacatggtgaaaccccgtctctactaaaatacaaaaaattagctgggtgtggtggcgcaaacctgtagtcgtagctacttgggaggctgaggcaggggaatcacttgaaccccggaggcggaggttgtagtgggccgagattgtgccactgcgctccagcgtgggcgacagagtgagactccatctcaaaaaaaaaaaaaaaaaatctatgctagtagattacaacttcacactagaggagttctggacaaagcttttaattagtcaaactaaattaaggctcattaaaaggaaaggaactactgggaaattatgcaattcaataatttagactctgttaccaggatctttcataaaaatttaatttccataatcataacctaaatgagttcttaaagaattctataagcaatagctgattaatgggccctggaagatgaagattataactgtttatttacctaattaaaaggaaaggcagtgccaaatatgagaggataaacaatattagttaacatttctgttatttatgatgccaattagtagtaagataattccacagctgtcaactttgtttggggctggcaacttctctgcttaaacaggctaaaagtttagtattctgggagaagtggctggaagaaggggtaatatggtgaaagcaaattccctttcccaggagtcaagagaatttatgtgaggtggcttcccgcctgtaatctcagcactttgggagggccaggcaggcaatcacctgaggccaggagaccagcctgactaacatggagaaaccccatctctactaaaaatacaaaatgagctgggcgt

SEQ ID NO: 369039 - DNA, 868 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
  misc_feature (771)..(771): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaagggtcctgcagagaacgccggacttgtgagcgtcnctttgcaagcgccaaggttcaccgtggccggttgatggccagacttcggacagcctggccaaaggtgaataggggggcacggtcccttcatggctta

SEQ ID NO: 369040 - DNA, 949 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacattgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacacaaaaaaaaactcgagggggggccggtaccccatttggcctatagtgagtcgattaccaattaatggccgtggtttacaactcgtgactggg

SEQ ID NO: 369041 - DNA, 1746 bp, Homo sapiens
cagcagtgtgaggcaatcgctctatccttgaccccttcctttgcacagtgagtgatggcgtttttatctcctgatgatgatgcacagccttcagcgggggacatttaagacgcagaacaccaggtccaggctgcagctgcgggactcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggccacagacttcgggaacatgcctgagcagaagggtgtcatcagggcggagcacggtcccacttgcatggtgcttcacccgttggctggaagtccctctaagaccaaacttacgtggctactcagcatcgacctcaaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacaca

SEQ ID NO: 369042 - DNA, 1752 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggccacagacttcgggaacatgcctgagcagaagggtgtcatcagggcggagcacggtcccacttgcatggtgcttcacccgttggctggaagtccctctaagaccaaacttacgtggctactcagcatcgacctcaaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacaca

SEQ ID NO: 369043 - DNA, 1803 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
  misc_feature (1772)..(1772): n is a, c, g, or t
  misc_feature (1779)..(1779): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggccacagacttcgggaacatgcctgagcagaagggtgtcatcagggcggagcacggtcccacttgcatggtgcttcacccgttggctggaagtccctctaagaccaaacttacgtggctactcagcatcgacctcaaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacacacaaaaaaaaaaaaaattcantggccgncgttttacaacgtcgtgacttggt

SEQ ID NO: 369044 - DNA, 2662 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggccacagacttcgggaacatgcctgagcagaagggtgtcatcagggcggagcacggtcccacttgcatggtgcttcacccgttggctggaagtccctctaagaccaaacttacgtggctactcagcatcgacctcaaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacacaaaacatcagtctttgttttaatattgtactgttaaaaaaatctatgcagctgggtgcagtggctcacgcctgtaatcccagcattttgggaggctgaggtaggcggatcacaaggtcaggagatcgagaccatcctggccaacatggtgaaaccccgtctctactaaaatacaaaaaattagctgggtgtggtggcgcaaacctgtagtcgtagctacttgggaggctgaggcaggggaatcacttgaaccccggaggcggaggttgtagtgggccgagattgtgccactgcgctccagcgtgggcgacagagtgagactccatctcaaaaaaaaaatttaattagtcaaactaaattaaggctcattaaaaggaaaggaactactgggaaattatgcaattcaataatttagactctgttaccaggatctttcataaaaatttaatttccataatcataacctaaatgagttcttaaagaattctataagcaatagctgattaatgggccctggaagatgaagattataactgtttatttacctaattaaaaggaaaggcagtgccaaatatgagaggataaacaatattagttaacatttctgttatttatgatgccaattagtagtaagataattccacagctgtcaactttgtttggggctggcaacttctctgcttaaacaggctaaaagtttagtattctgggagaagtggctggaagaaggggtaatatggtgaaagcaaattccctttcccaggagtcaagagaatttatgtgaggtggcttcccgcctgtaatctcagcactttgggagggccaggcaggcaatcacctgaggccaggagaccagcctgactaacatggagaaaccccatctctactaaaaatacaaaatgagctgggcgt

SEQ ID NO: 369045 - DNA, 1784 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggccacagacttcgggaacatgcctgagcagaagggtgtcatcagggcggagcacggtcccacttgcatggtgcttcacccgttggctggaagtccctctaagaccaaacttacgtggctactcagcatcgacctcaaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacacattaccccaaaaccataaagaaaaaaaataaaa

SEQ ID NO: 369046 - DNA, 2660 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggccacagacttcgggaacatgcctgagcagaagggtgtcatcagggcggagcacggtcccacttgcatggtgcttcacccgttggctggaagtccctctaagaccaaacttacgtggctactcagcatcgacctcaaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacacaaaacatcagtctttgttttaatattgtactgttaaaaaaatctatgcagctgggtgcagtggctcacgcctgtaatcccagcattttgggaggctgaggtaggcggatcacaaggtcaggagatcgagaccatcctggccaacatggtgaaaccccgtctctactaaaatacaaaaaattagctgggtgtggtggcgcaaacctgtagtcgtagctacttgggaggctgaggcaggggaatcacttgaaccccggaggcggaggttgtagtgggccgagattgtgccactgcgctccagcgtgggcgacagagtgagactccatctcaaaaaaaaaaaaaaaaaatctatgctagtagattacaacttcacactagaggagttctggacaaagcttttaattagtcaaactaaattaaggctcattaaaaggaaaggaactactgggaaattatgcaattcaataatttagactctgttaccaggatctttcataaaaatttaatttccataatcataacctaaatgagttcttaaagaattctataagcaatagctgattaatgggccctggaagatgaagattataactgtttatttacctaattaaaaggaaaggcagtgccaaatatgagaggataaacaatattagttaacatttctgttatttatgatgccaattagtagtaagataattccacagctgtcaactttgtttggggctggcaacttctctgcttaaacaggctaaaagtttagtattctgggagaagtggctggaagaaggggtaatatggtgaaagcaaattccctttcccaggagtcaagagaatttatgtgaggtggcttcccgcctgtaatctcagcactttgggagggccaggcaggcaatcacctgaggccaggagaccagcctgactaacatggagaaaccccatctctactaaaaatacaaaatgagctgggcgt

SEQ ID NO: 369047 - DNA, 1702 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggccacagacttcgggaacatgcctgagcagaagggtgtcatcagggcggagcacggtcccacttgcatggtgcttcacccgttggctggaagtccctctaagaccaaacttacgtggctactcagcatcgacctcaaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgttgggggtcagattaggtatcattattcacccaac

SEQ ID NO: 369048 - DNA, 1709 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggccacagacttcgggaacatgcctgagcagaagggtgtcatcagggaagtccctctaagaccaaacttacgtggctactcagcatcgacctcaaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacaca

SEQ ID NO: 369049 - DNA, 1658 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggccacagacttcgggaacatgcctgagcagaagggtgtcatcaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacaca

SEQ ID NO: 369050 - DNA, 2065 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggtaagtgctgaggcttctgggctcctggtgctgctggcaggaggttccctggagggtgatgtggtgcatgtggctttggctcccctcctgccattccttcattttgagaggacgtccccagcctagagttcctcaaggccagatccctctctggtcacctggggcggctgtgattaactcgaccagcaggctggcccctatggctttagtccgggctcttcagagcaatgagcagacccagagctccagggatgagagctggtggaggctgggagaagaaggaagctctgtctctcctcggctgtgtatccaggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggccacagacttcgggaacatgcctgagcagaagggtgtcatcagggcggagcacggtcccacttgcatggtgcttcacccgttggctggaagtccctctaagaccaaacttacgtggctactcagcatcgacctcaaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacaca

SEQ ID NO: 369051 - DNA, 1698 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggccacagacttcgggaacatgcctgagcagaagggtgtcatcagggcggagcacggtcccacttgcatggtgcttcacccgttggctggaagtccctctaagaccaaacttacgtggctactcagcatcgacctcaaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacaca

SEQ ID NO: 369052 - DNA, 1601 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggcaggaaacctggtggggccccgtgactttgtgagcgtgcgctgtgccaagcgccgaggctccacctgtgtgctggctggcatggccacagacttcgggaacatgcctgagcagaagggtgtcatcaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacaca

SEQ ID NO: 369053 - DNA, 887 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagcgggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacaca

SEQ ID NO: 369054 - DNA, 2010 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacacaaaacatcagtctttgttttaatattgtactgttaaaaaaatctatgcagctgggtgcagtggctcacgcctgtaatcccagcattttgggaggctgaggtaggcggatcacaaggtcaggagatcgagaccatcctggccaacatggtgaaaccccgtctctactaaaatacaaaaaattagctgggtgtggtggcgcaaacctgtagtcgtagctacttgggaggctgaggcaggggaatcacttgaaccccggaggcggaggttgtagtgggccgagattgtgccactgcgctccagcgtgggcgacagagtgagactccatctcaaaaaaaaaaaaaaaaaatctatgctagtagattacaacttcacactagaggagttctggacaaagcttttaattagtcaaactaaattaaggctcattaaaaggaaaggaactactgggaaattatgcaattcaataatttagactctgttaccaggatctttcataaaaatttaatttccataatcataacctaaatgagttcttaaagaattctataagcaatagctgattaatgggccctggaagatgaagattataactgtttatttacctaattaaaaggaaaggcagtgccaaatatgagaggataaacaatattagttaacatttctgttatttatgatgccaattagtagtaagataattccacagctgtcaactttgtttggggctggcaacttctctgcttaaacaggctaaaagtttagtattctgggagaagtggctggaagaaggggtaatatggtgaaagcaaattccctttcccaggagtcaagagaatttatgtgaggtggcttcccgcctgtaatctcagcactttgggagggccaggcaggcaatcacctgaggccaggagaccagcctgactaacatggagaaaccccatctctactaaaaatacaaaatgagctgggcgt

SEQ ID NO: 369055 - DNA, 880 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaagtggccctgcagaagaacggaaaggatcgatacattactgacgacctggctgtcaatgcattaggctcacactggtgctggttggattggcaagactatgggacatgctgaccgtaggtagtcttcggccgtcacgggaccact

SEQ ID NO: 369056 - DNA, 818 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagctcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtggattaaccaggttcggcggcggagctctctactcggttctcggctggaagagactctctacagtgaccaggagctggcctatctccagcagggggaggaggccatgcagaaggccttgggcatccttagcaaccaagagggctggaagaaggagagtcagcaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaagcaacatcgacaaacctcttataaccccataactttttaaacctacgctagtccaaaccccgaaactcacctatttcctact

SEQ ID NO: 369057 - DNA, 1441 bp, Homo sapiens
  misc_feature (74)..(74): n is a, c, g, or t
  misc_feature (80)..(81): n is a, c, g, or t
  misc_feature (92)..(92): n is a, c, g, or t
  misc_feature (105)..(105): n is a, c, g, or t
  misc_feature (107)..(107): n is a, c, g, or t
  misc_feature (113)..(113): n is a, c, g, or t
ggcggagggggcgaccgtaacgcggtatcggtgggagcgcgtatggcaacgacccacgagagccggcatcgacncccttnnggaggggccancaggacttaggcncnctaganctagcggatcccccgggctgcaggaattcggcacgagcaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacacaaaacatcagtctttgttttaatattgtactgttaaaaaaatctatgcagctgggtgcagtggctcacgcctgtaatcccagcattttgggaggctgaggtaggcggatcacaaggtcaggagatcgagaccatcctggccaacatggtgaaaccccgtctctactaaaatacaaaaaattagctgggtgtggtggcgcaaacctgtagtcgtagctacttgggaggctgaggcaggggaatcacttgaaccccggaggcggaggttgtagtgggccgagattgtgccactgcgctccagcgtgggcgacagagtgagactccatctcaaaaaaaaaaaaaaaaaatctatgctagtagattacaacttcacactagaggagttctggacaaagcttttaattagtcaaactaaattaaggctcattaaaaggaaaggaactactgggaaattatgcaattcaataatttagactctgttaccaggatctttcataaaaatttaatttccataatcataacctaaatgagttcttaaagaattctataagcaatagctgattaatgggccctggaagatgaagattataactgtttatttacctaattaaaaggaaaggcagtgccaaatatgagaggataaacaatattagttaacatttctgttatttatgatgccaattagtagtaagataattccacagctgtcaactttgtttggggctggcaacttctctgcttaaacaggctaaaagtttagtattctgggagaagtggctggaagaaggggtaatatggtgaaagcaaattccctttcccaggagtcaagagaatttatgtgaggtggcttcccgcctgtaatctcagcactttgggagggccaggcaggcaatcacctgaggccaggagaccagcctgactaacatggagaaaccccatctctactaaaaatacaaaatgagctgggcgt

SEQ ID NO: 369058 - DNA, 7427 bp, Homo sapiens
cgctaggagtccctagcggccagggcgtggaagcggattctgaggcggctttctcctactgccctccgcttgccaacgcgggacccggagcccaacggcagcggcggtccttgggcctgtggagaggggttctctgtggccgagtcctaggcctggtgaaccgcgcggtgcgggagaggcgcttgggcctcgtccagccccagcccctgtctccccgcggccggtgccggcggctgtaggcctcgccgcgcccacccagcctggggcgggcccagcctcaccgcccggcccgccccgccccacgggccagccccgcgccgggtgtttccgctacttccctgcggcggggtaaccgcctcgcacctaccgggctcggttccctggctccggccgcggggggagcatggagtttgcggagctgattaagaccccgcgggtggacaatgtggtgctgcaccggcctttctacccggctgtcgagggcaccctgtgcctgacgggccaccacttgatcctgtcctcccggcaggacaatacggaggagctgtggctcctccattcaaacatcgacgccatcgacaagcgatttgtaggatcactgggtaccatcatcataaaatgtaaagattttcgaattattcagttggatattcctggaatggaggaatgcttgaatatagccagttccattgaggcattgtctactctggactccatcactctgatgtaccctttcttttaccgtcctatgtttgaagtgatagaagatggctggcattccttccttcctgagcaagaatttgaactctattcttcagctaccagtgaatggaggctaagctatgtcaataaggaatttgctgtctgtccctcttacccaccaattgtcacagtgcccaaatccatcgatgatgaagctcttcggaaggtagctacatttcgacatggagggcgcttcccagtactaagctattaccacaaaaaaaatgggatggtaattatgcgaagtggtcagccactcactggtacaaacgggaggaggtgcaaggaggacgagaagctgataaatgctaccctcagggctggaaagcgtggctacatcattgacacccgatccctgaacgtggctcagcaaactagagccaaaggaggtggctttgaacaagaagctcattatcctcagtggaggcgaattcataagtccattgagaggtatcacattcttcaggagagcttaatcaaacttgtggaagcttgtaatgaccaaacacataacatggaccgatggctcagtaaattggaggcctctaactggctgactcacatcaaagagattctgacaactgcctgcctagcggctcagtgcatcgacagggaaggagcatcaatattgattcacggaacagaaggaactgattccacactccaggtgacctccttggcccagatcatcttagagccaagaagcaggaccattcgtggttttgaggccctgattgaaagagagtggctgcaggctggtcacccattccagcagcgctgtgcacagtcagcctactgtaacaccaagcagaagtgggaggctcctgtatttcttctcttcttggactgcgtgtggcagatccttcgtcagtttccctgttcttttgagtttaatgagaatttcctcatcatgctctttgagcatgcttatgcctcacagtttggaacatttctgggcaacaatgaaagtgaaagatgtaagttgaagctacagcagaagacgatgtctttgtggtcctgggttaatcagcccagtgagctgagtaaattcaccaatcccctctttgaagccaacaaccttgtcatctggccttcagttgctccgcagagtcttccactgtgggaaggtattttcctacgttggaatagatcctctaagtatttggatgaagcatatgaagaaatggttaacatcattgaatataataaagaattacaagcaaaagtcaatatccttcgaaggcagttggcagaactggaaacagaggacgggatgcaggagagtccctgaaaggtctcctcgcacccttcgcaaggaccttcttgggcctgtgtccgccgttctctccttgtgcccttcagttcacttttacacggtagccttgaagtgaaggctttagatgtgggacccccctaatgtaatggatttctcaatactgtatgaataatgaaacttactatcataaaccatgtttcatgtggcctgttagggcctgtcactttgggagccggaaggaggtgctagtcattttatttttacgtgaaatagatgacctatttaatgccatttgtgtttcatgccattttatccaaagctttttctctgtgtccactctccaaacagcattctagagcagtcaaggagacagctaatctctctagggactatttggtggtttaaaaaaagggtcagacttttaaacactctgaccatagaaatgtttttcaaaatggcaacaatggataaaccaaggattttgtgtttaacaatccatttccagtgtcttcgccacataaaatagccattttctttaaaatagttttggactaacgaagctgaaatctattctcattcttgtttgtcaagaaaggaaaatctgttattcaaggtaaattatttctacaagggcaacaggtatggtcctccgatatttacattaagaagagttaaatttattttaacgtagacactaaaagtatgtgcaatatacaattaaagtaggaatttgttactgattgagaattgttactggtgaattggttttcaggttttgagcatacatatacaatgtgtttcaaatgctgcttgtaaaattaaaccatcatctagaatagagttaatttattataatcaagctacaaataggttttcttaaaccagagatgcactgcccttgtctaaagttcttattgcactggtttatatgtgtatgtgtgttttattgtgtgtttttttaatttgtaagtattctaagagtttcctaatactaaggttaaaattttcatgttgacctgagccttttgcaaatttgctttggctctattgatttgtccattatgtgttaggcaaatataacttaagtggagggggaagtttatgaatataatatagctctgtgttttaaacctcagaaacagatttgagtgtttcagtattatagaaacagtgatgactattcatgctctgctagtctatgcctgcaactccaaatgtttgtggttcagtatttcccacctacatttctgtttggtgacattgctcattttaacaaatatgaccgagtctagtttttctttaaaaggatagtttatgagtaatctttaaaaccatttccataccatctgtatataaccatttcggtagagaacacactacactgaaccctgctttagagctgtgtgttgagctaaaaatataattttttaaaaattgactagcaaaatctatggccacactgagaagcctttgaaaatggcaaatacttttcatcaccaattgcccaattcatctttcttctgcttcctcagccttgtagcaaaggctacacagcagcccacagtccacagtctttttgggaaaattggcctgccaccttctttaagctcagtttatttttgacttactttctttgctgtagttatgaaccttggggcattaaaatcccatggcaaggagcataagagatgttctcgtagctctgcgttgtgtgaaatgtccatcttagttttgttaaaaaaaaaaaaaaaaaaaggaaacagcctcacttttttgtgctccctcagaattgcttgctatgtctgttaatacagctgagctttttgttttcttctctttttgtctcaagattgtatatgaaggaggcttttcttctcagctaacaggcatataaggaaaaccatctagagagttttctttagaagtgactcccattagcctggtgtggtggtgtgtgcctatagtcccagccactaggaaagctgaggcagaaggatcccttgagcctaggaggttgaggctgcagtgagctatgatcgcatcagtccactccagcctgagcaacagagcgagaccctgtgtctaagtaaagaaaaagccagaagtgactcccactgcttctgttgatcggccatagggcttccatgggtggaaacttgtgagggagtttgtattaggtctggtcatggagggatgatgtaccatcaaggtagacccatcttcctgatgcacatttgctgtgcgagccagagtacagtcataacacggtattcgcatttcgttttctctgtctcactgagacaacaatctatactgttttggcaagtttgcattttagtattaatttataattagggattgttcaaacttcagatctgtttacaggttgtaaaaataaacttcggtatcagtgcatctacagaagtgttatttggtaatccaaatattagagttttcccaaatccaaaaacggtcagaaataagtccattatcaatataatttgaagaagatttttagtagtactgtgaagttcgtgcttacctggatgagaagaataaatgacacggatacactcctgagaagacactcgttaaacattgcatcggagagctgcctttgataaatgtgctgttaaacacttgaatgaagagaatggtggcagaatgagtgagcaagcagattgccccagaggggccggtaataatcacgtgagggataatcagattcctgcgtattcagcatcttctctattcatgtggagtgaaagctggtttttatacaggagatacgtaaagtaggccccacaaataatatttttaaaatacaaaggatcaccacaatcctctattgaacatataaggatcctcagatttaaataagtactttttttttttttaatcagaagaacattgttgtttgattatatgtttttaaaaacctgaagcttttttggtggcaggacctttcaataaatatttatttggtcaaaattttttattttgattttattaaatgggaagaaagcaagcagaaatagtaaaattcagtaggtttaaaacaatctataaatgtattttatttccaagaaaacttagggtctcaaagcaagattttaaagtgatttttgagaagacttgggggggacaataatagacattcatgtcagatcccatatgggggatttttaaacatttctttgaactttgaggcctgatttaggggtgggattttattgctttttgttttaaaggatgaaattttgtggggttttagtctttgattcagtcagtatttggtttatgttaaataaaaaatcagtatcatggaaaagatatgaccataatttagtctcctcaagtgaaaaacaggagtaatgtttcgttgcactttgaaagatctgcttcaaggcataactcgtgtagttgtctggtttcagggatagctgtttgaattgtcattctaaagtaggtcatcaggttcacttattatccgaccttaatctgggataaaggttttggtatttgcccacttctagatagaatgaatgaaaacaacacaagcgttttatgagcactctttatcagaaaggtatttcctggaccagaaatgggcaatagttacaatagttgatcctctgttctggaagctttgaaatttatcagagaatgaagtcattcagtacatctgataaagttttgttgttgttgttgttgttgttgttttaattgggcaaccctcagaactgaagaggttcagagaactttccaggtttatactatacctcaagaccacatagattagctactgcttattctttcacatgggctaggcctgttctcctcctccagacctagtattctaagttattaccacatagtatttttatgttacccatcatctttaaaaacattataggctgggcatggtggcttacgcctgtaatcccagcactttgggaggccaaggcgggcggatcatgaggtcaggagatcgagaccatcctggctaacacggtgaaaacccatgtctactaaaaatacaaaaaattagccaggtgtggtggcgggcgcctgtagtcccagctactcaggaggctgaggcaggagaatggtgtgaacccgggaggcagagcttgcagtgagccgagatcgcaccactgcactccagcctgggcgaaagggcaagactccatctcaaaaaaaaaaaaaaaaaaagactcatttatccatttacatttattctcagatgataaaatatatactgatactataactttcttatggtatcagttttctttattttcttgaataaaattacttctaccttcatttggtctttataatccactgtccacagcatcttcctttaaaccaatagtcccagaagagaccctctgaaattctaggactggatattaaaatgcctgaacctgttatctaaatcctttttaagaaacttaatgttccagctcttgaactacactgtggaacagtaatttgtgcccaatttagtggaagataatgaggctcactgtaaacactacattgtcctgcaaagtaattctgatgagagtttactgacttctagagccattctctttaaccgtctgcaggtctaaggattaactatatttgtgatttgtaataaaactgaattgtacaacactgcctgtgtttgtctggccaagacatttgcttcacttttaaaatgcacgttatctttggagaggtgaattattctacaaaatgcaccctaaatctcattgtttaaaaccttactgatctaataccatctacacaaaaaaatgttgtacttgcagaacttagtttataaaaacaaagaatgtgtatttcttcaatagccgggtatttggattgttctcttgataatatttgaatgtgactcttggatttaagtgcactattattcatggcttatacaataaaattgcactgtatggcaaatatgtctataatgtatgctttgctgaaacctcaagagtgctgtaaggtacaggtttccatattgtgaacctgtgtacgcacacacacatatacatacagtcttagggaaaaaaaaaagcagaacttttgtaagtctgtgtaacattttaatattgtttgtaatattcactaggtgataatttcccctgtaccctataactgtaatcattcaccttgggttggccggtttgtcaagcttggtttactgaatcaagaaagagtcttgtcgaatgtggtactgttcttagtgtgtaatatttgcgtatggtgttcctctgcctcagaggacagttgcacagatggctagtgttaaatttctatagacgatggtaataaaatctgaatatatttaagtgctaataaattaaatctgtgggcttatttg

SEQ ID NO: 369059 - DNA, 810 bp, Homo sapiens
cgctaggagtccctagcggccagggcgtggaagcggattctgaggcggctttctcctactgccctccgcttgccaacgcgggacccggagcccaacggcagcggcggtccttgggcctgtggagaggggttctctgtggccgagtcctaggcctggtgaaccgcgcggtgcgggagaggcgcttgggcctcgtccagccccagcccctgtctccccgcggccggtgccggcggctgtaggcctcgccgcgcccacccagcctggggcgggcccagcctcaccgcccggcccgccccgccccacgggccagccccgcgccgggtgtttccgctacttccctgcggcggggtaaccgcctcgcacctaccgggctcggttccctggctccggccgcggggggagcatggagtttgcggagctgattaagaccccgcgggtggacaatgtggtgctgcaccggcctttctacccggctgtcgagggcaccctgtgcctgacgggccaccacttgatcctgtcctcccggcaggacaatacggaggagctgtggctcctccattcaaacatcgacgccatcgacaagcgatttgtaggatcactgggtaccatcatcataaaatgtaaagattttcgaattattcagttggatattcctggaatggaggaatgcttgaatatagccagttccattgaggcattgtctactctggactccatcactctgatgtaccctttcttttaccgtcctatgtttgaagtgatagaagatggctggcattccttcaaacataggacggtaaaaaaaaaaaa

SEQ ID NO: 369060 - DNA, 5773 bp, Homo sapiens
gtactactactagtccactgaattctcagtgatgcttatgcctcacagtttggaacatttctgggcaacaatgaaagtgaaagatgtaagttgaagctacagcagaagacgatgtctttgtggtcctgggttaatcagcccagtgagctgagtaaattcaccaatcccctctttgaagccaacaaccttgtcatctggccttcagttgctccgcagagtcttccactgtgggaaggtattttcctacgttggaatagatcctctaagtatttggatgaagcatatgaagaaatggttaacatcattgaatataataaagaattacaagcaaaagtcaatatccttcgaaggcagttggcagaactggaaacagaggacgggatgcaggagagtccctgaaaggtctcctcgcacccttcgcaaggaccttcttgggcctgtgtccgccgttctctccttgtgcccttcagttcacttttacacggtagccttgaagtgaaggctttagatgtgggacccccctaatgtaatggatttctcaatactgtatgaataatgaaacttactatcataaaccatgtttcatgtggcctgttagggcctgtcactttgggagccggaaggaggtgctagtcattttatttttacgtgaaatagatgacctatttaatgccatttgtgtttcatgccattttatccaaagctttttctctgtgtccactctccaaacagcattctagagcagtcaaggagacagctaatctctctagggactatttggtggtttaaaaaaagggtcagacttttaaacactctgaccatagaaatgtttttcaaaatggcaacaatggataaaccaaggattttgtgtttaacaatccatttccagtgtcttcgccacataaaatagccattttctttaaaatagttttggactaacgaagctgaaatctattctcattcttgtttgtcaagaaaggaaaatctgttattcaaggtaaattatttctacaagggcaacaggtatggtcctccgatatttacattaagaagagttaaatttattttaacgtagacactaaaagtatgtgcaatatacaattaaagtaggaatttgttactgattgagaattgttactggtgaattggttttcaggttttgagcatacatatacaatgtgtttcaaatgctgcttgtaaaattaaaccatcatctagaatagagttaatttattataatcaagctacaaataggttttcttaaaccagagatgcactgcccttgtctaaagttcttattgcactggtttatatgtgtatgtgtgttttattgtgtgtttttttaatttgtaagtattctaagagtttcctaatactaaggttaaaattttcatgttgacctgagccttttgcaaatttgctttggctctattgatttgtccattatgtgttaggcaaatataacttaagtggagggggaagtttatgaatataatatagctctgtgttttaaacctcagaaacagatttgagtgtttcagtattatagaaacagtgatgactattcatgctctgctagtctatgcctgcaactccaaatgtttgtggttcagtatttcccacctacatttctgtttggtgacattgctcattttaacaaatatgaccgagtctagtttttctttaaaaggatagtttatgagtaatctttaaaaccatttccataccatctgtatataaccatttcggtagagaacacactacactgaaccctgctttagagctgtgtgttgagctaaaaatataattttttaaaaattgactagcaaaatctatggccacactgagaagcctttgaaaatggcaaatacttttcatcaccaattgcccaattcatctttcttctgcttcctcagccttgtagcaaaggctacacagcagcccacagtccacagtctttttgggaaaattggcctgccaccttctttaagctcagtttatttttgacttactttctttgctgtagttatgaaccttggggcattaaaatcccatggcaaggagcataagagatgttctcgtagctctgcgttgtgtgaaatgtccatcttagttttgttaaaaaaaaaaaaaaaaaaaggaaacagcctcacttttttgtgctccctcagaattgcttgctatgtctgttaatacagctgagctttttgttttcttctctttttgtctcaagattgtatatgaaggaggcttttcttctcagctaacaggcatataaggaaaaccatctagagagttttctttagaagtgactcccattagcctggtgtggtggtgtgtgcctatagtcccagccactaggaaagctgaggcagaaggatcccttgagcctaggaggttgaggctgcagtgagctatgatcgcatcagtccactccagcctgagcaacagagcgagaccctgtgtctaagtaaagaaaaagccagaagtgactcccactgcttctgttgatcggccatagggcttccatgggtggaaacttgtgagggagtttgtattaggtctggtcatggagggatgatgtaccatcaaggtagacccatcttcctgatgcacatttgctgtgcgagccagagtacagtcataacacggtattcgcatttcgttttctctgtctcactgagacaacaatctatactgttttggcaagtttgcattttagtattaatttataattagggattgttcaaacttcagatctgtttacaggttgtaaaaataaacttcggtatcagtgcatctacagaagtgttatttggtaatccaaatattagagttttcccaaatccaaaaacggtcagaaataagtccattatcaatataatttgaagaagatttttagtagtactgtgaagttcgtgcttacctggatgagaagaataaatgacacggatacactcctgagaagacactcgttaaacattgcatcggagagctgcctttgataaatgtgctgttaaacacttgaatgaagagaatggtggcagaatgagtgagcaagcagattgccccagaggggccggtaataatcacgtgagggataatcagattcctgcgtattcagcatcttctctattcatgtggagtgaaagctggtttttatacaggagatacgtaaagtaggccccacaaataatatttttaaaatacaaaggatcaccacaatcctctattgaacatataaggatcctcagatttaaataagtactttttttttttttaatcagaagaacattgttgtttgattatatgtttttaaaaacctgaagcttttttggtggcaggacctttcaataaatatttatttggtcaaaattttttattttgattttattaaatgggaagaaagcaagcagaaatagtaaaattcagtaggtttaaaacaatctataaatgtattttatttccaagaaaacttagggtctcaaagcaagattttaaagtgatttttgagaagacttgggggggacaataatagacattcatgtcagatcccatatgggggatttttaaacatttctttgaactttgaggcctgatttaggggtgggattttattgctttttgttttaaaggatgaaattttgtggggttttagtctttgattcagtcagtatttggtttatgttaaataaaaaatcagtatcatggaaaagatatgaccataatttagtctcctcaagtgaaaaacaggagtaatgtttcgttgcactttgaaagatctgcttcaaggcataactcgtgtagttgtctggtttcagggatagctgtttgaattgtcattctaaagtaggtcatcaggttcacttattatccgaccttaatctgggataaaggttttggtatttgcccacttctagatagaatgaatgaaaacaacacaagcgttttatgagcactctttatcagaaaggtatttcctggaccagaaatgggcaatagttacaatagttgatcctctgttctggaagctttgaaatttatcagagaatgaagtcattcagtacatctgataaagttttgttgttgttgttgttgttgttgttttaattgggcaaccctcagaactgaagaggttcagagaactttccaggtttatactatacctcaagaccacatagattagctactgcttattctttcacatgggctaggcctgttctcctcctccagacctagtattctaagttattaccacatagtatttttatgttacccatcatctttaaaaacattataggctgggcatggtggcttacgcctgtaatcccagcactttgggaggccaaggcgggcggatcatgaggtcaggagatcgagaccatcctggctaacacggtgaaaacccatgtctactaaaaatacaaaaaattagccaggtgtggtggcgggcgcctgtagtcccagctactcaggaggctgaggcaggagaatggtgtgaacccgggaggcagagcttgcagtgagccgagatcgcaccactgcactccagcctgggcgaaagggcaagactccatctcaaaaaaaaaaaaaaaaaaagactcatttatccatttacatttattctcagatgataaaatatatactgatactataactttcttatggtatcagttttctttattttcttgaataaaattacttctaccttcatttggtctttataatccactgtccacagcatcttcctttaaaccaatagtcccagaagagaccctctgaaattctaggactggatattaaaatgcctgaacctgttatctaaatcctttttaagaaacttaatgttccagctcttgaactacactgtggaacagtaatttgtgcccaatttagtggaagataatgaggctcactgtaaacactacattgtcctgcaaagtaattctgatgagagtttactgacttctagagccattctctttaaccgtctgcaggtctaaggattaactatatttgtgatttgtaataaaactgaattgtacaacactgcctgtgtttgtctggccaagacatttgcttcacttttaaaatgcacgttatctttggagaggtgaattattctacaaaatgcaccctaaatctcattgtttaaaaccttactgatctaataccatctacacaaaaaaatgttgtacttgcagaacttagtttataaaaacaaagaatgtgtatttcttcaatagccgggtatttggattgttctcttgataatatttgaatgtgactcttggatttaagtgcactattattcatggcttatacaataaaattgcactgtatggcaaatatgtctataatgtatgctttgctgaaacctcaagagtgctgtaaggtacaggtttccatattgtgaacctgtgtacgcacacacacatatacatacagtcttagggaaaaaaaaaagcagaacttttgtaagtctgtgtaacattttaatattgtttgtaatattcactaggtgataatttcccctgtaccctataactgtaatcattcaccttgggttggccggtttgtcaagcttggtttactgaatcaagaaagagtcttgtcgaatgtggtactgttcttagtgtgtaatatttgcgtatggtgttcctctgcctcagaggacagttgcacagatggctagtgttaaatttctatagacgatggtaataaaatctgaatatatttaagtgctaataaattaaatctgtgggcttatttg

SEQ ID NO: 369061 - DNA, 2943 bp, Homo sapiens
  misc_feature (2894)..(2894): n is a, c, g, or t
cgctaggagtccctagcggccagggcgtggaagcggattctgaggcggctttctcctactgccctccgcttgccaacgcgggacccggagcccaacggcagcggcggtccttgggcctgtggagaggggttctctgtggccgagtcctaggcctggtgaaccgcgcggtgcgggagaggcgcttgggcctcgtccagccccagcccctgtctccccgcggccggtgccggcggctgtaggcctcgccgcgcccacccagcctggggcgggcccagcctcaccgcccggcccgccccgccccacgggccagccccgcgccgggtgtttccgctacttccctgcggcggggtaaccgcctcgcacctaccgggctcggttccctggctccggccgcggggggagcatggagtttgcggagctgattaagaccccgcgggtggacaatgtggtgctgcaccggcctttctacccggctgtcgagggcaccctgtgcctgacgggccaccacttgatcctgtcctcccggcaggacaatacggaggagctgtggctcctccattcaaacatcgacgccatcgacaagcgatttgtaggatcactgggtaccatcatcataaaatgtaaagattttcgaattattcagttggatattcctggaatggaggaatgcttgaatatagccagttccattgaggcattgtctactctggactccatcactctgatgtaccctttcttttaccgtcctatgtttgaagtgatagaagatggctggcattccttccttcctgagcaagaatttgaactctattcttcagctgtgagttaacttttgagaactgtggattatgagaagtaacccaataccttatttgacttgtgaaaatgatcacttcttttgaagagtaataaggtgaagttgacttatccattcctaatcttaatatatttaaaaggattgaagccatgcagagtatgatctctgatcacaaaggaattagattaataatcagtaatactaagatatctaggaatacccccaagtatttctaaattaaacagaacgcttgtaaataatctgcatgtcaaagaaattagaaaacattttgaagtgagtgataatggttatgtaacatattgaaatttgtggaatacagacagctaaggcagtgtttagagataaacttacagctttaaaatttttactagaaaggaaagtctaaaattattgacctaagcaccaatttaagaagctagaaaaaaaaaagcaaagtaactagaaagaaaaaataataaaaataagagcagaaagcaataaaataactagaataagtaagtttagcaaagttggttgatataagatcggtatacaaaaacgaattgaattggcaacaagcgatctgacaatgaataaaatatttacgaataaatttaacaaaagaaattcaaggtctatacactgaaagacataaaacattgttggaagaagttgcaagagatctaaataaaaggagagatactgtgtacatcaattggaagacaatattgttaaggttagtggttggctgacttttgtgaaagaccattagatagtagatattttaagctttgcaggtcatgtggtctctgttgtaactactgaactctgctgttgttgcatgaaaaaagcaatcagatgagacatcagtgaatgggtggtgctatgttctaataaactttatttgcagaaacaagtagcaggctggatttggctcattaaagtggcagttctcccttaattgatctgtagagtcagtgcaatccctgttaaaattctaataggtgtttttgtagaaatggacaaaatgatacaaattttatggaaatgcaaatttaaatatataagtttatatggaaagtcaaaacagctttgagaaaacacttgattactgtaaagccacagtaatcaagagagtatggtattgctgtaagcgaagacatacagaccaatgaaacagaatacagggtacagaaataaaccttccccttaatgctcagttgatttttgacaaaagtaccaatacaattcaattgggaaaggatagctttttcaaccaatagtattggaacagttggatatccatatgtaaaaaagataaacctagacccttacctcacatcatccacaaaaattaactaaaatgtattatgcaactaaacatgagaactaaaactatcaaacctctttaagaaagcacaggagaaaatctttatgaccttcagttagacagagattttttagatatgacaccaaaagtgactgaaagcaggttagtgatttcctagtattgggtgttacacaggtgtatacaactgtcaagactcatgaaattgtgtagtcaaaatggattcagtttattttttataagttttgtctcaataaagttgactaaaaagaagataaaagaataatctaatgcaaatgttaagtagctgattagaaacagcttaggagaaaataagtgatttgaaatatagatccgaaataattactcagaatatggaacagagaaggaagatggaaaaacagagaggttagacacatgcatgcttaataaaggaagaagatccaatatttattacatgggagtttaggataaaagatgatagaggctggttatggtggctcacacctatagtcctagcacttaaggaggctgaggcaggcaggtcacttgagctcaggagagtttgagaccagcctaggcaacatggcgaaaccccatctctatgaaaaaatttagctaggtgtgataatgtgtgtctttggtcccagttacctgggggtctgaggtgggagaatggcttgagcccagaaagttgagtttgcagtgagcagtgataatgccgctgcnctccagcctgggtgagagagcaagaccttgtctccaaaaaaaaaaaaaa

SEQ ID NO: 369062 - DNA, 1639 bp, Homo sapiens
cgctaggagtccctagcggccagggcgtggaagcggattctgaggcggctttctcctactgccctccgcttgccaacgcgggacccggagcccaacggcagcggcggtccttgggcctgtggagaggggttctctgtggccgagtcctaggcctggtgaaccgcgcggtgcgggagaggcgcttgggcctcgtccagccccagcccctgtctccccgcggccggtgccggcggctgtaggcctcgccgcgcccacccagcctggggcgggcccagcctcaccgcccggcccgccccgccccacgggccagccccgcgccgggtgtttccgctacttccctgcggcggggtaaccgcctcgcacctaccgggctcggttccctggctccggccgcggggggagcatggagtttgcggagctgattaagaccccgcgggtggacaatgtggtgctgcaccggcctttctacccggctgtcgagggcaccctgtgcctgacgggccaccacttgatcctgtcctcccggcaggacaatacggaggagctgtggctcctccattcaaacatcgacgccatcgacaagcgatttgtaggatcactgggtaccatcatcataaaatgtaaagattttcgaattattcagttggatattcctggaatggaggaatgcttgaatatagccagttccattgaggcattgtctactctggactccatcactctgatgtaccctttcttttaccgtcctatgtttgaagtgatagaagatggctggcattccttccttcctgagcaagaatttgaactctattcttcagctaccagtgaatggaggctaagctatgtcaataaggaatttgctgtctgtccctcttacccaccaattgtcacagtgcccaaatccatcgatgatgaagctcttcggaaggtagctacatttcgacatggagggcgcttcccagtactaagctattaccacaaaaaaaatgggatggtaattatgcgaagtggtcagccactcactggtacaaacgggaggaggtgcaaggaggacgagaagctgataaatgctaccctcagggctggaaagcgtggctacatcattgacacccgatccctgaacgtggctcagcaaactagagccaaaggaggtggctttgaacaagaagctcattatcctcagtggaggcgaattcataagtccattgagaggtatcacattcttcaggagagcttaatcaaacttgtggaagcttgtaatgaccaaacacataacatggaccgatggctcagtaaattggaggcctctaactggctgactcacatcaaagagattctgacaactgcctgcctagcggctcagtgcatcgacaggtaaagtgcatttcagcgttcctgagcgaaacatgacgttgctaattagactttgtgtttatccagacatatgtttatagattatgtgaaagtttgcagtaaattactgtgtaggctagtcaacaccatcccattattgatgaggtgtgtgcctagagtctggcatttaatagataatgtttgtttcataaatatgaaccaggtaaatatacatgtcttctatgacacaaatttttaagtactaatggaccccgttttttttttc

SEQ ID NO: 369063 - DNA, 7155 bp, Homo sapiens
cgctaggagtccctagcggccagggcgtggaagcggattctgaggcggctttctcctactgccctccgcttgccaacgcgggacccggagcccaacggcagcggcggtccttgggcctgtggagaggggttctctgtggccgagtcctaggcctggtgaaccgcgcggtgcgggagaggcgcttgggcctcgtccagccccagcccctgtctccccgcggccggtgccggcggctgtaggcctcgccgcgcccacccagcctggggcgggcccagcctcaccgcccggcccgccccgccccacgggccagccccgcgccgggtgtttccgctacttccctgcggcggggtaaccgcctcgcacctaccgggctcggttccctggctccggccgcggggggagcatggagtttgcggagctgattaagaccccgcgggtggacaatgtggtgctgcaccggcctttctacccggctgtcgagggcaccctgtgcctgacgggccaccacttgatcctgtcctcccggcaggacaatacggaggagctgtggctcctccattcaaacatcgacgccatcgacaagcgatttgtaggatcactgggtaccatcatcataaaatgtaaagattttcgaattattcagttggatattcctggaatggaggaatgcttgaatatagccagttccattgaggcattgtctactctggactccatcactctgatgtaccctttcttttaccgtcctatgtttgaagtgatagaagatggctggcattccttccttcctgagcaagaatttgaactctattcttcagctaccagtgaatggaggctaagctatgtcaataaggaatttgctgtctgtccctcttacccaccaattgtcacagtgcccaaatccatcgatgatgaagctcttcggaaggtagctacatttcgacatggagggcgcttcccagtactaagctattaccacaaaaaaaatgggatggtaattatgcgaagtggtcagccactcactggtacaaacgggaggaggtgcaaggaggacgagaagctgataaatgctaccctcagggctggaaagcgtggctacatcattgacacccgatccctgaacgtggctcagcaaactagagccaaaggaggtggctttgaacaagaagctcattatcctcagtggaggcgaattcataagtccattgagaggtatcacattcttcaggagagcttaatcaaacttgtggaagcttgtaatgaccaaacacataacatggaccgatggctcagtaaattggaggcctctaactggctgactcacatcaaagagattctgacaactgcctgcctagcggctcagtgcatcgacagggaaggagcatcaatattgattcacggaacagaaggaactgattccacactccaggtgacctccttggcccagatcatcttagagccaagaagcaggaccattcgtggttttgaggccctgattgaaagagagtggctgcaggctggtcacccattccagcagcgctgtgcacagtcagcctactgtaacaccaagcagaagtgggaggctcctgtatttcttctcttcttggactgcgtgtggcagatccttcgtcagtttccctgttcttttgagtttaatgagaatttcctcatcatgctctttgagcatgcttatgcctcacagtttggaacatttctgggcaacaatgaaagtgaaagatgtaagttgaagctacagcagaagacgatgtctttgtggtcctgggttaatcagcccagtgagctgagtaaattcaccaatcccctctttgaagccaacaaccttgtcatctggccttcagttgctccgcagagtcttccactgtgggaaggtattttcctacgttggaatagatcctctaagtatttggatgaagcatatgaagaaatggttaacatcattgaatataataaagaattacaagcaaaagtcaatatccttcgaaggcagttggcagaactggaaacagaggacgggatgcaggagagtccctgaaaggtctcctcgcacccttcgcaaggaccttcttgggcctgtgtccgccgttctctccttgtgcccttcagttcacttttacacggtagccttgaagtgaaggctttagatgtgggacccccctaatgtaatggatttctcaatactgtatgaataatgaaacttactatcataaaccatgtttcatgtggcctgttagggcctgtcactttgggagccggaaggaggtgctagtcattttatttttacgtgaaatagatgacctatttaatgccatttgtgtttcatgccattttatccaaagctttttctctgtgtccactctccaaacagcattctagagcagtcaaggagacagctaatctctctagggactatttggtggtttaaaaaaagggtcagacttttaaacactctgaccatagaaatgtttttcaaaatggcaacaatggataaaccaaggattttgtgtttaacaatccatttccagtgtcttcgccacataaaatagccattttctttaaaatagttttggactaacgaagctgaaatctattctcattcttgtttgtcaagaaaggaaaatctgttattcaaggtaaattatttctacaagggcaacaggtatggtcctccgatatttacattaagaagagttaaatttattttaacgtagacactaaaagtatgtgcaatatacaattaaagtaggaatttgttactgattgagaattgttactggtgaattggttttcaggttttgagcatacatatacaatgtgtttcaaatgctgcttgtaaaattaaaccatcatctagaatagagttaatttattataatcaagctacaaataggttttcttaaaccagagatgcactgcccttgtctaaagttcttattgcactggtttatatgtgtatgtgtgttttattgtgtgtttttttaatttgtaagtattctaagagtttcctaatactaaggttaaaattttcatgttgacctgagccttttgcaaatttgctttggctctattgatttgtccattatgtgttaggcaaatataacttaagtggagggggaagtttatgaatataatatagctctgtgttttaaacctcagaaacagatttgagtgtttcagtattatagaaacagtgatgactattcatgctctgctagtctatgcctgcaactccaaatgtttgtggttcagtatttcccacctacatttctgtttggtgacattgctcattttaacaaatatgaccgagtctagtttttctttaaaaggatagtttatgagtaatctttaaaaccatttccataccatctgtatataaccatttcggtagagaacacactacactgaaccctgctttagagctgtgtgttgagctaaaaatataattttttaaaaattgactagcaaaatctatggccacactgagaagcctttgaaaatggcaaatacttttcatcaccaattgcccaattcatctttcttctgcttcctcagccttgtagcaaaggctacacagcagcccacagtccacagtctttttgggaaaattggcctgccaccttctttaagctcagtttatttttgacttactttctttgctgtagttatgaaccttggggcattaaaatcccatggcaaggagcataagagatgttctcgtagctctgcgttgtgtgaaatgtccatcttagttttgttaaaaaaaaaaaaaaaaaaaggaaacagcctcacttttttgtgctccctcagaattgcttgctatgtctgttaatacagctgagctttttgttttcttctctttttgtctcaagattgtatatgaaggaggcttttcttctcagctaacaggcatataaggaaaaccatctagagagttttctttagaagtgactcccattagcctggtgtggtggtgtgtgcctatagtcccagccactaggaaagctgaggcagaaggatcccttgagcctaggaggttgaggctgcagtgagctatgatcgcatcagtccactccagcctgagcaacagagcgagaccctgtgtctaagtaaagaaaaagccagaagtgactcccactgcttctgttgatcggccatagggcttccatgggtggaaacttgtgagggagtttgtattaggtctggtcatggagggatgatgtaccatcaaggtagacccatcttcctgatgcacatttgctgtgcgagccagagtacagtcataacacggtattcgcatttcgttttctctgtctcactgagacaacaatctatactgttttggcaagtttgcattttagtattaatttataattagggattgttcaaacttcagatctgtttacaggttgtaaaaataaacttcggtatcagtgcatctacagaagtgttatttggtaatccaaatattagagttttcccaaatccaaaaacggtcagaaataagtccattatcaatataatttgaagaagatttttagtagtactgtgaagttcgtgcttacctggatgagaagaataaatgacacggatacactcctgagaagacactcgttaaacattgcatcggagagctgcctttgataaatgtgctgttaaacacttgaatgaagagaatggtggcagaatgagtgagcaagcagattgccccagaggggccggtaataatcacgtgagggataatcagattcctgcgtattcagcatcttctctattcatgtggagtgaaagctggtttttatacaggagatacgtaaagtaggccccacaaataatatttttaaaatacaaaggatcaccacaatcctctattgaacatataaggatcctcagatttaaataagtactttttttttttttaatcagaagaacattgttgtttgattatatgtttttaaaaacctgaagcttttttggtggcaggacctttcaataaatatttatttggtcaaaattttttattttgattttattaaatgggaagaaagcaagcagaaatagtaaaattcatatcatggaaaagatatgaccataatttagtctcctcaagtgaaaaacaggagtaatgtttcgttgcactttgaaagatctgcttcaaggcataactcgtgtagttgtctggtttcagggatagctgtttgaattgtcattctaaagtaggtcatcaggttcacttattatccgaccttaatctgggataaaggttttggtatttgcccacttctagatagaatgaatgaaaacaacacaagcgttttatgagcactctttatcagaaaggtatttcctggaccagaaatgggcaatagttacaatagttgatcctctgttctggaagctttgaaatttatcagagaatgaagtcattcagtacatctgataaagttttgttgttgttgttgttgttgttgttttaattgggcaaccctcagaactgaagaggttcagagaactttccaggtttatactatacctcaagaccacatagattagctactgcttattctttcacatgggctaggcctgttctcctcctccagacctagtattctaagttattaccacatagtatttttatgttacccatcatctttaaaaacattataggctgggcatggtggcttacgcctgtaatcccagcactttgggaggccaaggcgggcggatcatgaggtcaggagatcgagaccatcctggctaacacggtgaaaacccatgtctactaaaaatacaaaaaattagccaggtgtggtggcgggcgcctgtagtcccagctactcaggaggctgaggcaggagaatggtgtgaacccgggaggcagagcttgcagtgagccgagatcgcaccactgcactccagcctgggcgaaagggcaagactccatctcaaaaaaaaaaaaaaaaaaagactcatttatccatttacatttattctcagatgataaaatatatactgatactataactttcttatggtatcagttttctttattttcttgaataaaattacttctaccttcatttggtctttataatccactgtccacagcatcttcctttaaaccaatagtcccagaagagaccctctgaaattctaggactggatattaaaatgcctgaacctgttatctaaatcctttttaagaaacttaatgttccagctcttgaactacactgtggaacagtaatttgtgcccaatttagtggaagataatgaggctcactgtaaacactacattgtcctgcaaagtaattctgatgagagtttactgacttctagagccattctctttaaccgtctgcaggtctaaggattaactatatttgtgatttgtaataaaactgaattgtacaacactgcctgtgtttgtctggccaagacatttgcttcacttttaaaatgcacgttatctttggagaggtgaattattctacaaaatgcaccctaaatctcattgtttaaaaccttactgatctaataccatctacacaaaaaaatgttgtacttgcagaacttagtttataaaaacaaagaatgtgtatttcttcaatagccgggtatttggattgttctcttgataatatttgaatgtgactcttggatttaagtgcactattattcatggcttatacaataaaattgcactgtatggcaaatatgtctataatgtatgctttgctgaaacctcaagagtgctgtaaggtacaggtttccatattgtgaacctgtgtacgcacacacacatatacatacagtcttagggaaaaaaaaaagcagaacttttgtaagtctgtgtaacattttaatattgtttgtaatattcactaggtgataatttcccctgtaccctataactgtaatcattcaccttgggttggccggtttgtcaagcttggtttactgaatcaagaaagagtcttgtcgaatgtggtactgttcttagtgtgtaatatttgcgtatggtgttcctctgcctcagaggacagttgcacagatggctagtgttaaatttctatagacgatggtaataaaatctgaatatatttaagtgctaataaattaaatctgtgggcttatttg

SEQ ID NO: 369064 - DNA, 697 bp, Homo sapiens
tttttgtgaattttcccaaaaaccattatgttaagaaattccaatctttctgctttacttgaactctcaagcatttgattttaggcatgtcacttcattttacattgaaatcgcccaaatgaatctctgactgtgacttgacacacacagaggaaggtctcattgaaacctcttttccctattttgggtagaagagtggtcatagatattacctgacaatctgtttcaactaagtttattttttcaaaaaaggaactcctcccccagattttagactgccttaaagtacaacaaacatctttactcttgactaactccaagtatttatttcttgctgcttgtgtgagagcaaatataaacatagttttatcagtgggcggctttcttggtctttgggttgcaaacaatgatttctttttgattctcactttgtctctgactgttgaaaagaaaatggcaagatattggggctgacctttctgcctccaagtttttgctgtagtcacaaggaaaggtgacctttaaggcctctcccagccatgagcttgagtaaaccacacattcttggatccacaggaaatgaaattgtgaaggtcatctttcagcccagagtggcttgggaggggctcatattcattaattaatttgccttttatgatctcagaattaaggatacatataaagattgagcttctga

SEQ ID NO: 369065 - DNA, 338 bp, Homo sapiens
caaggcagaagtccttaggcgggacttccttaccaccacgggtgctaaaagaagagttagtaggtcatgcttctaccagtaatctaaggactctctccttctcttcttcctctttctccagatttccaagccttagctaagagtaatttggcttgtttagtattgttttcttatggtccagttaattaccaaaaatatttttaaaatcatctctgttaatagaatgtctaccaacttctcactatcagaaaatactcaacctccaaacaatttgaaattatctttctgatccaggtaaagaagcaaattgaaaatcaataaagtaaaaagtgacggag

SEQ ID NO: 369066 - DNA, 427 bp, Homo sapiens
catctttaaaaatacccatcttgaagtctgtatttactgtaagcatttcaatttaattaaatactaactttggatttggaaccgaattctgatttttttctgacctacttgtgatgttaacgaactttttaaaaaattacttatttttttagggccgggtgtggtcgtcacgcctgtaatccaggcactttgggaggccaaggtggttggatcccttgaggccaggggtttgagaacaacatggcaaaatctcatctctataaaaatacaaaaattagtcaggtgtggtggtgtgcacctgtgatcccagctactcaggaggctgaggcacaagaatcacttgaacctgggaggcagaggttgcagtgagccaagatcgtgtcaccacactccagcctgagtgacagagcgactctctcttaaaaaa

SEQ ID NO: 369067 - DNA, 322 bp, Homo sapiens
atctcacccacaaaacacccctggaaggtgctagagcatgctaaatacagctggtgaaagcgaggtggaagtaaaagcgtggggtggagatggcagaggagcaggtgtctgcaaagccaagcacctcccgggccccgtacgacgacactggatggaacattccaaaggaaagtgtgcaccatggttattttcaaatgtcaaccaaccatgttctgtaacaatcgtctcctactaccccaacaatattctcatggaaaagtattcttccctgaaaaacgatcatccaagaagatttccatccaacatatctccccaaaaaggt

SEQ ID NO: 369068 - DNA, 555 bp, Homo sapiens
ttcacccaatctgcttgactcaaaaaaacaccaatttaaatgtgactctcatctaaaaacatcctcacagaaacatccaaaatagtgtttgaccaaatatctgtacaatgtggcccatctaaattgacataaaattaaccatcacatataatgatcatacctagatgtgatttagtctgagtatgccataagacctcacaagtctttctcaggctctacgtgaagtcatttcctgtggggattcaagctcaccagttaatgcctactgctttattcccaccagaaacccaccatttctttctatcttgtcttatagctttctacccacaaacaaggttgatatgtatttcagcacactatggcacgacaggcatgtagaagctctattttgtccatcgtaaccaggaacctttctaagcttttagtcattgaggcttacagttacacagtgatcagtcctctgggagttgtatactgcataatttgatagcccagccaggagcagtttctggaaattcttcccaaatgatatcctttgtagtagatgtaacctga

SEQ ID NO: 369069 - DNA, 651 bp, Homo sapiens
acaatagccaggcgaagaaactacaactcccagggcgtcccggagcaggccaacgggactacgggaagcagcgggcagcggcccgcgggaggcacctcggagatctgggtgcaaaagcccagggttaggaaccgtaggcatgctgcgccccaaggctttgacccaggtgctaagccaagccaacactggaggcgtccagagcaccctgctgctgaataacgagggatcactgctggcctactctggttacggggacactgacgcccgggtcaccgctgccatagccagtaacatctgggccgcctacgaccggaacgggaaccaagcgtttaatgaagacaatctcaaattcatcctcatggactgcatggagggccgtgtagccatcacccgagtggccaaccttctgctgtgtatgtatgccaaggagaccgtgggctttggaatgctcaaggccaaggcccaggctttggtgcagtacctggaggagcccctcacccaagtggcggcatcttaacggcattggtggaagctggggtcagaaaagagaaatgaccatttggaggggcggggcctcctagaagaaccttcttagacaatggggggaggatgggactttgttttttccaagaataaacttcaactcctgtc

SEQ ID NO: 369070 - DNA, 901 bp, Homo sapiens
acaatagccaggcgaagaaactacaactcccagggcgtcccggagcaggccaacgggactacgggaagcagcgggcagcggcccgcgggaggcacctcggagatctgggtgcaaaagcccagggttaggaaccgtaggcatgctgcgccccaaggctttgacccaggtgctaagccaagccaacactggaggcgtccagagcaccctgctgctgaataacgagggatcactgctggcctactctggttacggggacactgacgcccgggtcaccgctgccatagccagtaacatctgggccgcctacgaccggaacgggaaccaagcgtttaatgaagacaatctcaaattcatcctcatggactgcatggtatggagaggggagccagacttcccctgtcccccaaaggggatcccaagggggcgacctggaccccatcctggatggttggaggggcagggacaggatctccggaagattactaagagttggtctgcagcagcatttgtaataggcaggaccctattcatcaagtggtggtgaggaaggatccctggacctgagaggtctgacttgggttctggtctcagccatccacttatcagttgtggaaccttgggagggccgtgtagccatcacccgagtggccaaccttctgctgtgtatgtatgccaaggagaccgtgggctttggaatgctcaaggccaaggcccaggctttggtgcagtacctggaggagcccctcacccaagtggcggcatcttaacggcattggtggaagctggggtcagaaaagagaaatgaccatttggaggggcggggcctcctagaagaaccttcttagacaatggggggaggatgggactttgttttttccaagaataaacttcaactcctgtc

SEQ ID NO: 369071 - DNA, 610 bp, Homo sapiens
acaatagccaggcgaagaaactacaactcccagggcgtcccggagcaggccaacgggactacgggaagcagcgggcagcggcccgcgggaggcacctcggagatctgggtgcaaaagcccagggttaggaaccgtaggcatgctgcgccccaaggctttgacccaggctgctgaataacgagggatcactgctggcctactctggttacggggacactgacgcccgggtcaccgctgccatagccagtaacatctgggccgcctacgaccggaacgggaaccaagcgtttaatgaagacaatctcaaattcatcctcatggactgcatggagggccgtgtagccatcacccgagtggccaaccttctgctgtgtatgtatgccaaggagaccgtgggctttggaatgctcaaggccaaggcccaggctttggtgcagtacctggaggagcccctcacccaagtggcggcatcttaacggcattggtggaagctggggtcagaaaagagaaatgaccatttggaggggcggggcctcctagaagaaccttcttagacaatggggggaggatgggactttgttttttccaagaataaacttcaactcctgtc

SEQ ID NO: 369072 - DNA, 861 bp, Homo sapiens
  misc_feature (659)..(660): n is a, c, g, or t
  misc_feature (662)..(662): n is a, c, g, or t
acaatagccaggcgaagaaactacaactcccagggcgtcccggagcaggccaacgggactacgggaagcagcgggcagcggcccgcgggaggcacctcggagatctgggtgcaaaagcccagggttaggaaccgtaggcatgctgcgccccaaggctttgacccaggtgctaagccaagccaacactggaggcgtccagagcaccctgctgctgaataacgagggatcactgctggcctactctggttacggggacactgacgcccgggtcaccgctgccatagccagtaacatctgggccgcctacgaccggaacgggaaccaagcgtttaatgaagacaatctcaaattcatcctcatggactgcatggagggccgtgtagccatcacccgagtggccaaccttctgctgtgtatgtatgccaaggagaccgtgggctttggaatgctcaaggccaaggcccaggctttggtgcagtacctggaggagcccctcacccaagtggcggcatcttaacggcattggtggaagctggggtcagaaaagagaaatgaccatttggaggggcggggcctcctagaagaaccttcttagacaatggggggaggatgggactttgttttttccaagaataaacttcaactcctgtcaaaaaacnnancaaaaaaaacgttgggggccgccgggccccaaaaaagcttttaacccactcgttgggcgcgggcccatgtgaattagcatcgggcaggggtcccaagaaaccgggctgaagggctggtttccccaataaaaacccggggacacccgcgttcggaacaacccaaggggtcggggcttcggattcacagggccaggcgaaa

SEQ ID NO: 369073 - DNA, 941 bp, Homo sapiens
acaatagccaggcgaagaaactacaactcccagggcgtcccggagcaggccaacgggactacgggaagcagcgggcagcggcccgcgggaggcacctcggagatctgggtgcaaaagcccagggttaggaaccgtaggcatgctgcgccccaaggctttgacccaggtgctaagccaagccaacactggaggcgtccagagcaccctgctgctgaataacgagggatcactgctggcctactctggttacggggacactgacgcccgggtcaccgctgccatagccagtaacatctgggccgcctacgaccggaacgggaaccaagcgtttaatgaagacaatctcaaattcatcctcatggactgcatggtatggagaggggagccagacttcccctgtcccccaaaggggatcccaagggggcgacctggaccccatcctggatggttggaggggcagggacaggatctccggaagattactaagagttggtctgcagcagcatttgtaataggcaggaccctattcatcaagtggtggtgaggaaggatccctggacctgagaggtctgacttgggttctggtctcagccatccacttatcagttgtggaaccttgggtaagtcgcttaacctctctcagcttccttacctcatgtttaaggagaagacaataatttccctctccccgctcccctcatgggttgttgtgaaggtcagatgaaataatgggtataaacagtagaatgacgtgcaaacacaaagtgttgtcatcccagtttcaccgactcacagaaccatggcagtctccagaccctagtccaaccccttaagctttcaaagaaaggaaaatgaagtccagaaaggggaagtcaccattagattgtgaacttcttagtatctgttcggtcgacaagtatttaggtccttgcagtattctc

SEQ ID NO: 369074 - DNA, 898 bp, Homo sapiens
acaatagccaggcgaagaaactacaactcccagggcgtcccggagcaggccaacgggactacgggaagcagcgggcagcggcccgcgggaggcacctcggagatctgggtgcaaaagcccagggttaggaaccgtaggcatgctgcgccccaaggctttgacccaggtgctaagccaagccaacactggaggcgtccagagcaccctgctgctgaataacgagggatcactgctggcctactctggttacggggacactgacgcccgggtcaccgctgccatagccagtaacatctgggccgcctacgaccggaacgggaaccaagcgtttaatgaagacaatctcaaattcatcctcatggactgcatggagggccgtgtagccatcacccgagtggccaaccttctgctgtgtatgtatgccaaggagaccgtgggctttggaatgctcaaggccaaggtgtgtatgtgcccatccctccatagccctgggcccagccttcgtgcttctacactgtgttcactcccaccaggaccctgtttctagagttctcatgtctactcagtccatttctggtgtgggccagctcccaagagcaggtgggggttgggggctggttgcttcctatggcactgggagcagacctggatttggggtccctaatgccaggctgtgtgcgggactgatctctgttctccctctgcaggcccaggctttggtgcagtacctggaggagcccctcacccaagtggcggcatcttaacggcattggtggaagctggggtcagaaaagagaaatgaccatttggaggggcggggcctcctagaagaaccttcttagacaatggggggaggatgggactttgttttttccaagaataaacttcaactcctgtc

SEQ ID NO: 369075 - DNA, 221 bp, Homo sapiens
aggtcccctgtcgaaaagggaagccggtgtgctgggtgcttagggcatgttccgggacacgctcaggccagagccttgctggatgtgcccttggtgggacttgggatggaaacccagacgttttactccccgctctgagcacatcgctatccctccccgcccctcaccaggctgctgaataacgagggatcactgctggcctactctggttacggggacac

SEQ ID NO: 369076 - DNA, 950 bp, Homo sapiens
acaatagccaggcgaagaaactacaactcccagggcgtcccggagcaggccaacgggactacgggaagcagcgggcagcggcccgcgggaggcacctcggagatctgggtgcaaaagcccagggttaggaaccgtaggcatgctgcgccccaaggctttgacccaggtgctaagccaagccaacactggaggcgtccagagcaccctgctgctgaataacgagggatcactgctggcctactctggttacggggacactgacgcccgggtcaccgctgccatagccagtaacatctgggccgcctacgaccggaacgggaaccaagcgtttaatgaagacaatctcaaattcatcctcatggactgcatggagggccgtgtagccatcacccgagtggccaaccttctgctgtgtatgtatgccaaggagaccgtgggctttggaatgctcaaggccaaggcccaggctttggtgcagtacctggaggagcccctcacccaagtggcggcatcttaacggcattggtggaagctggggtcagaaaagagaaatgaccatttggaggggcggggcctcctagaagaaccttcttagacaatggggggaggatgggactttgttttttccaagaataaacttcaactcctgtcaaaaaaaaaaaaaaaacaaaaaaaatttggagggggctgggcccttagaaaaggtttaaaaccaattgcgtgggagcgcggggccccaagaagtatacggaacactgggcacaacgcgtggtccccaaagagaagaacccgggacacaacaaaagggccggggaatactccgacatatataaaaagggccgcggggaaacaccagagaggtctgtggaccaaactccaaaaggggagagccagagacacaaacggggcgacctacacaacgggagccagagaaccccgatactaagtga

SEQ ID NO: 369077 - DNA, 688 bp, Homo sapiens
acaatagccaggcgaagaaactacaactcccagggcgtcccggagcaggccaacgggactacgggaagcagcgggcagcggcccgcgggaggcacctcggagatctgggtgcaaaagcccagggttaggaaccgtaggcatgctgcgccccaaggctttgacccaggtgctaagccaagccaacactggaggcgtccagagcaccctgctgctgaataacgagggatcactgctggcctactctggttacggggacactgacgcccgggtcaccgctgccatagccagtaacatctgggccgcctacgaccggaacgggaaccaagcgtttaatgaagacaatctcaaattcatcctcatggactgcatggagggccgtgtagccatcacccgagtggccaaccttctgctgtgtatgtatgccaaggagaccgtgggctttggaatgctcaaggccaaggctgtgtgcgggactgatctctgttctccctctgcaggcccaggctttggtgcagtacctggaggagcccctcacccaagtggcggcatcttaacggcattggtggaagctggggtcagaaaagagaaatgaccatttggaggggcggggcctcctagaagaaccttcttagacaatggggggaggatgggactttgttttttccaagaataaacttcaactcctgtc

SEQ ID NO: 369078 - DNA, 921 bp, Homo sapiens
acaatagccaggcgaagaaactacaactcccagggcgtcccggagcaggccaacgggactacgggaagcagcgggcagcggcccgcgggaggcacctcggagatctgggtgcaaaagcccagggttaggaaccgtaggcatgctgcgccccaaggctttgacccaggtgctaagccaagccaacactggaggcgtccagagcacccttgacgcccgggtcaccgctgccatagccagtaacatctgggccgcctacgaccggaacgggaaccaagcgtttaatgaagacaatctcaaattcatcctcatggactgcatggcccaggctttggtgcagtacctggaggagcccctcacccaagtggcggcatcttaacggcattggtggaagctggggtcagaaaagagaaatgaccatttggaggggcggggcctcctagaagaaccttcttagacaatggggggaggatgggactttgttttttccaagaataaacttcaactcctgtcaacaaaaacaccgtacacgaccaaccgacccccacccaaccacccccacacacatctttggcgccccccgcctctgccgaccaccggagaaaaaaccctggtgtacacaaccccacccgccgttatggggcaggcgccaggcggaccccccgagacgcacacggcgaccacgacagggtgctctataagccggctgattccccacaacgacaaaaaccgcgtgcgccccaagacaacaccaaaggccgcggcgggaacccgcccccacccagagaaaaacaacacggccgccgggcggcacaaaccgacaagcgtcctgcaaccaaagatccccaagagaggtcagacaccgccaacaggcggcgaccccaaaacccaggcagcgaccacgggggcgcgaatatcgcagtg

SEQ ID NO: 369079 - DNA, 350 bp, Homo sapiens
tgagacagactcttgctctgttgcccaggctggagcacagtggtgtgatgttggctcactgcaacctctccctcccaggttcaagtgattcttgtgcctcagcctcccgagtagttgggactatagacacacaccaccctgccctgctaatttttgtattattggtagaaatcaggtttcactatgttggccaggctgttcttaaactcctgacctcaagtgatccaccttccttggcctctcaaagtggattacagtcatgagccactgcgcctggccagtattactttttcactagtgttacagcaacagttactttcacttctaaaaacatataatcaaatggcttt

SEQ ID NO: 369080 - DNA, 464 bp, Homo sapiens
atgtttcttttcctcgttggaccagcaggctagctgaggcatgttatcctcatgacagtggcagaggcataagaggaaaagtgggaaaacacacaatctcttacagcccaggctcaaaactagattgccagttctgcttcattctagtacagctggatattggggtcgaaagtgcagttttccatgaatattaattaaagtttgaaatgaggctgggcatggaggctcacacctgtaataccagcactttgggaggccaaggcgggaggatcacgaggtcaggagtttgagagcggcctgcccaacatggtgaaaccccatctctactaaaactacaaaaattagccaggcgtggtggcacgcgcctgtactcccagctactcaggaggctgaggcaggagaatcgcttgaacctgggaggtggagtttgcagtgagctgagattgtgccaccacactccaggc

SEQ ID NO: 369081 - DNA, 2623 bp, Homo sapiens
  misc_feature (230)..(230): n is a, c, g, or t
  misc_feature (306)..(306): n is a, c, g, or t
  misc_feature (2151)..(2151): n is a, c, g, or t
taaattatactttaagttttagggtacatgtgcacattgtgcaggttagttacatatgtatacatgtgacctggctacctttaaagatggatattgactcctccaaaatgctttcacttgaaaaaaaaaagaagaaaaaaacctcaaaaatgagaagggctttccgacttgaggaaagcaaatctttttaacttgcactaggaacatcacgacattttcttgcctcttanatggtttgtattttggatgcttctgaagagaaacaaagacatatagaatttaaacattatctgtgtttatttgtanaatacttattttttgtattttgttttttaaatgagtatgtctgatatctcatacatttagaatatttgtaatagaatagcaaatttccaccatggaatcagtggagagctatgcaatttaacaactgcaaagaatcttagagatccttagagtaacacatcctcttatttacaaatggggaaacagggtatacgagtagaagtgacttgcctaatccataagctaggggtacaacagggtcattagggccatcctgttcaatttctccctgatatgatcctagcgatggagtacctaccaactttctttacaatagcccaacgtctagtatgagaatcattctgtggacactcttccaaattgaaacaatctccttggattactcctggcacagcttatgtattctcatagccaatcccctggtcatgactctgacactagtagataaaaagtatcactctaatctcttgatcttttcatcatgcctttatttttacacatgcagtactcagagtctaaacaaaccttagcttgcattttcctcttaaaagcccaccatggatctcacagttttgttgttgttgttgttgttgttgttgttgttgttgagacgggatctcactctgttgccaggctggagtgcagtggcacaatcttggctcactgcaacctccgactccttggttgttcaagtgattctcttgcctcagcctcccaaatagctgagattacaggcacgcgccaccaggcccagctaatttttgtatttttagtagagacagcgtttcaccatgttggccaggatggtctcgatctcctgacctcgtgatccacccacctcagccttccaaagtgctgggattacaggcgtgagccaccgcgcccggcctcttgtagtttttaaaattaaatttaatccaataaaacatttagtttgcctttatttggaatttgttatctattgttatatactctattaatacctcctcttcagcaaggaaattttcttacatctgcttacacgtacatcatttgttagagcccctaaatattggtaatgatgatgatgatattatagcatgaattactttacgttgaacattggcctaagtgctttaaacacattatttgcctagcatttacaacatttttgtaggtattatttgtcacaattacattttcttgttctatgatataatttgttttgatatcgtattagttttctattgttcccctactgaattaccacaaatttattacattgtgggattgtaagtctgaagtccaataggggtctcactagcctaaagttaaggtgtcggcaggactgtgttctgttttggagactctaggagaaaatctgtctccttgccttttccagcttcttgatgccattcatagcttctttcatgatctggcatcctatacgttatacttattttctgattatattttgcctaacctctgtgagatattaattatttgagggcagagatttttatttgtttgttcataactatatccaggtgccttaaaatgatgcctgacacaaaataggtactcaatcaacataggttaataaatgaatgagcaaaaagttttattgtgcatattaattgttacctgggggaatatactcagacatcttaagtctcatatgtaaacttggggtattgatatcaacatgccattttgaggattaattgaggttatgtctataaatacctactagcatagtgtctagcacatagtatgaaaacattgtattattattatttattaaaatggcattttgttttctttatagcacctgacactatccaaattgccttttctgtttttttntttttacttatttcttaattgtttcacaaaggcagagtcttgtatgctttgcctctatgtctttagtacctagaatagtgcctgtttaaaagtaggagctgaataaatgtttgctgaattaatattaatcatgtgtaggaaaagaagcttgggaatgttattctaccacccacagctgtgcccactattatgatggttgttttgtgtgttctttctcaaggattcactttcagaactcaaaatggggtgtagggtggtggtggtgccagcagtggggatgggagaagctcgatctctccctacagtagaagtgcttactgctctatgtgttcttcagccctataagaaccaatgaaagccatccacacttccctcgatactggacatccctacatactcacagcagtctgcaaaacatatccaagggcccactgagacactgaagatgacccattgatttaatacatatttg

SEQ ID NO: 369082 - DNA, 119 bp, Homo sapiens
ttaaaatatatttcctagttcttttaaattaaaatgatttgtatttagatatttacaaagactgggtagattgaggagtgttaaaactgatataaaccaaagacattttgtgccattag

SEQ ID NO: 369083 - DNA, 476 bp, Homo sapiens
gtgtaatcagtcaccatggagttttttaataggacagcttctgctcttacagagcagagtttttatgccagtaggttagaagcataacatgtttctatattgaagtgattctccaacaaggacttcttttcatcaggggtgacctaaaagttattacttgaaatataattacatcatgttcttaactgggtttagtagtaggataattacaaggttgtatccacctcaaataggaagaactgataagttttgcacaattatttaactcctctgttaggccttccttatttcctgttctctttttaaaatttgactaagatattgctaatgggcttgggagcctataaaatgatcagaattgttgccttatgttttgcatgtttggggtaacattggagccagatgtactcttaaataaaaggtaggcctacaaaaccagtttctcagttgcattcaaaatgtgattaaaaaaaaaa

SEQ ID NO: 369084 - DNA, 471 bp, Homo sapiens
ctggcatatacagtggaaaaggaagaagggcaagtgttttactatacgatcacatatgggtcatacgccccttttactacctatatgcccatcctgccacctctaagacataaagttccatagccagagatacaggactggtgaaatgaagatggcttatgatgaaacctgctgccttcttaaaattgcaaccactgcaccttttctggaagccagatcaagtttcaaacttgcagcaccaatgaggcatttgaagatgattcgcttagcctcagtgaaagtctagagagcctagcatcacagtcccaattcagcaccccaatctctgacttacaattacctctggatctcaaggaagatttatgtatatatgtttccttttacctatttctatgtcttataggttgaatgtatgtatgcatatggatttgaggattacagagtattttaaaagtctaaaatgtaatgaaa

SEQ ID NO: 369085 - DNA, 624 bp, Homo sapiens
atccgtatacataagcttcagaatctatcttctacttaaaaataagttcctatgcaatttgactgaacttaaaaagaacatgtaacaagctgtttagagaaataaaatgttcactcttcaagctctgtagtagtaattaagggtatctacgtttacgtacttctatttgctttttatccattcctcagcgatcacatatgggtcatacgccccttttactacctatatgcccatcctgccacctctaagacataaagttccatagccagagatacaggactggtgaaatgaagatggcttatgatgaaacctgctgccttcttaaaattgcaaccactgcaccttttctggaagccagatcaagtttcaagtaagtacaatatttcaaacctctgtaactcaggtatctgtaaaaagctgtgaggaatcatgttcagtatgtatctaaatacaaaaagcaatgtatgcacaaagatagtcattaatgagttacttctcatttgaatgcctagtaaaaaaaaggagtcttaaggtaaatctacgccccagaattcactgtcatgtggcagtgaattaaaaattgtatttctgggccaggcgcagtggctcatgcctgtaatccca

SEQ ID NO: 369086 - DNA, 403 bp, Homo sapiens
tatacgtggtcccagcacagactaaggaatccaactatcattgggcaagccatgctaggtatgcatgcctttggggctctgcaggggatagcgctatgcagggatggttgagagctggttttggggttgagacacgtgggaaatacttggactttgggctgagcctgtggtgctcaatcccggctgcatgttgggaccacagggagatgacaaaaccatccccagccctcaccctagggccctcgaatgagcatctcaggggtctaggaggcctccacaaagacctactgattggcacacacttgtttctctaggaagagaacttacagctgcaggcaggagcatgtcttaatctgcttgggctgccataagtaccacagactgggagggtttaacaacagaa

SEQ ID NO: 369087 - DNA, 394 bp, Homo sapiens
gtctctccacattctcttccctctatgcatgtctgtctctgtgtccaaatttgtcctttttaaaggacatcagtcctgggtgggcgtggtggctcacgcctgtaatctcagcactttgggaagccaacgcgggcagatcacctgaggtcaggagttccagaccagcctggccaacacggtgaaaccccgtctctactaaaaatacaaaaatcagcctggcgtggtggtgcatgcctgtaatcccagctacttagaggctgaggcaggagaatctcttgaaccagggaggtggatgttgcagtgagccaaaatttcatcactgcactccagcctaggccacagagcgagactctgtctcaaaaacaaacaaacaacaaacaacaacacaacaaaa

SEQ ID NO: 369088 - DNA, 357 bp, Homo sapiens
cgaaaaaagaaagcagaaagtgagttttgggcaagggaacagtagacatggagtgaggggtgggatccgtggggctgatgtagatagggtggcagcagggacaatgatggcttcggtgactaagacaggggagagaggagaggagcccgggggttggaagctgctccctcaccaggaagaagcagagtaggcacgtcaggtctcttctccccattgtgacatgcaaagtgtaaattttaaggataactggcagaaacagaaagattcaaggagactccagttcctcctccagcctggggctccagggcctcaaccataacttctaccaagagcccactcacactcagtgcagtggcc

SEQ ID NO: 369089 - DNA, 3191 bp, Homo sapiens
cgcggggcggaaggatcgcgttgccagctgcggcggccgccacagccacagccgccgccgccgccgccgccgcccctgcccctgccgcccctgcccctgccgttaggtggtggggtttctcagcccggcggcgggaggcgggccggcctcggcttcctgtcggaggacgcgcaaggatccgggcgtcggagtgtgtgcgagtgcgtgagtgtgtgtcggtcgcacggcgtgtgtctccggccgcgggttccgcctcctcccctgccgccgctgctcacggtgtaagtcaatgtgaagcagcagctccagccccgggataaacatggcgacgtctctgcatgagggacccacgaaccagctggatctgctcatccgggccgtggaagcatcagttcacagcagtaatgcacactgtacagataagacaattgaagctgctgaagccctgcttcatatggaatctcctacctgcttgagggattcaagaagtcctgtggaagtgtttgttcctccttgtgtatcaactccagaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaagcagctcactacgatatcaagttacactaagacttggaacactaacattctgtaagaggttatatagttttcagtgggaggggttgggatgggtaatctcattgttacatatagcaatttttgatgcattttatatgcataccagcaattattactgtgttcgcacagttctcacttaactggtgctatgtgaagactctgctaatataggtattttagaatgtgaattgaagaatggatcccaaaaacttcagaaagaggatagcaaaaaaagatctagtgcgatttatatatatatatatatatatatacatacatatatatatatcatatagcttaagctgatttaaaacaaaggccttagactaattttcgattttctttcttgaaataagctaatggcttgtttgtgtaaagcttttttattaaaagaaaaattttaaaaatcttgtacctagcacagtattgttatagaatatacatgtaacattttatatggtagtttaagtctgtcagtttcttaattgtggacaaattaacagttggctctggccttttgctgtaacatgcctgtgtcactcacttagccttggcatttgtgcagacataccattttcagttctgctgtcacttggaagttcaggctcagcatgaatttttggcaggtagctctaatacctggagttttctttgtttttttttcttttttttagttgaagtttatgagggaaataccagtgttcagttttgaactataatagtttgtatattcaacatttgaagtatattctattttgttgtactcttgtttcaaagtgtattcaagtaggttttctgaaatatagaaatgaaatttatcttctgttttggtctctggtgatattttaaacaatatttaaaagtcagtatagaagtgttttagttaggaagtgataaaacatctctcttctccttcccaactactgcatgaagaaattctacttccattatattaatatttgggc

SEQ ID NO: 369090 - DNA, 2592 bp, Homo sapiens
cgcggggcggaaggatcgcgttgccagctgcggcggccgccacagccacagccgccgccgccgccgccgccgcccctgcccctgccgcccctgcccctgccgttaggtggtggggtttctcagcccggcggcgggaggcgggccggcctcggcttcctgtcggaggacgcgcaaggatccgggcgtcggagtgtgtgcgagtgcgtgagtgtgtgtcggtcgcacggcgtgtgtctccggccgcgggttccgcctcctcccctgccgccgctgctcacggtgtaagtcaatgtgaagcagcagctccagccccgggataaacatggcgacgtctctgcatgagggacccacgaaccagctggatctgctcatccgggccgtggaagcatcagttcacagcagtaatgcacactgtacagataagacaattgaagctgctgaagccctgcttcatatggaatctcctacctgcttgagggattcaagaagtcctgaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaagcagctcactacgatatcaagttacactaagacttggaacactaacattctgtaagaggttatatagttttcagtgggaggggttgggatgggtaatctcattgttacatatagcaatttttgatgcattttatatgcataccagcaattattactgtgttcgcacagttctcacttaactggtgctatgtgaagactctgctaatataggtattttagaatgtgaattgaagaatggatcccaaaaacttcagaaagaggatagcaaaaaaagatctagtgcgatttatatatatatatatatatatatacatacatatatatatatcatatagcttaagctgatttaaaacaaaggccttagactaattttcgattttctttcttgaaataagctaatggcttgtttgtgtaaagcttttttattaaaagaaaaatttt

SEQ ID NO: 369091 - DNA, 934 bp, Homo sapiens
gccgccgtcgcctaggcggttgggggtcggtggggcggcgcgggcgggggtcgctgcgcggggcggcgagcctctgttttgtctccttctctccctgtggagcggctcgggctgctggggaggccccggctccctccggacgctcggccaacggcggcggctagtccgcggccctgctgagagggaaaaggacgccgcggtcttcccaggcgtcgcggagagcagttccaaagaactactggttcagattttagctcttcccaagttgtgaaaatagtgaaggatgcttagactacttaacatacaaactgctttctggttaatcatctttagaagactggatttctggatatctactccactccatctctattgacttttaaaacatgataatgcaaacctataacactggcaaccatcagtgaacctttaatttcattgattaatagcgtttgaagcttcctcagggaataacaatgacatcagcagtggttgacagtggaggtactattttggagctttccagcaatggagtagaaaatcaagaggaaagtgaaaaggtttctgaatatccagcagtgattgtggagccagttccaagtgccagattagagcagggctatgcagcccaggttctggtttatgatgatgagacttatatgatgcaagatgtggcagaagaacaagaagttgagaccgagaatgtggaaacaggtggaatctcactctgtcacccaggctggagtgcggtggtgtgatctcggctcactgcaacctccgcctcccgggttcaagtgattctcctgcctcagcctcccaagtggctgggactacagaaatcctccctgtggcacaaaaggactcctttaattagaaaatattgttgccacagggaggtagaagatcgacatgaaaaactggggatctgaaaacg

SEQ ID NO: 369092 - DNA, 834 bp, Homo sapiens
gccgccgtcgcctaggcggttgggggtcggtggggcggcgcgggcgggggtcgctgcgcggggcggcgagcctctgttttgtctccttctctccctgtggagcggctcgggctgctggggaggccccggctccctccggacgctcggccaacggcggcggctagtccgcggccctgctgagagggaaaaggacgccgcggtcttcccaggcgtcgcggagagcagttccaaagaactactggttcagattttagctcttcccaagttgtgaaaatagtgaaggatgcttagactacttaacatacaaactgctttctggttaatcatctttagaagactggatttctggatatctactccactccatctctattgacttttaaaacatgataatgcaaacctataacactggcaaccatcagtgaacctttaatttcattgattaatagcgtttgaagcttcctcagggaataacaatgacatcagcagtggttgacagtggaggtactattttggagctttccagcaatggagtagaaaatcaagaggttaggcattcaatgaattacatttctattttcttcatagaaatttgtgcatgaactaattttgaaattaataggaaacatatttgagagtaaaaatgtacaaagcatgaaattatacatgtacatgtcgtgtatccttatataatttaggtaatagaaggtcaaggaaggtattgcagggcttacgtgaattgttggaacatacatatattagaatgaacttggagggaggaaaggaatggaaagaacactatagtattagttgagagttaaatttaaatccctc

SEQ ID NO: 369093 - DNA, 2921 bp, Homo sapiens
cgcggggcggaaggatcgcgttgccagctgcggcggccgccacagccacagccgccgccgccgccgccgccgcccctgcccctgccgcccctgcccctgccgttaggtggtggggtttctcagcccggcggcgggaggcgggccggcctcggcttcctgtcggaggacgcgcaaggatccgggcgtcggagtgtgtgcgagtgcgtgagtgtgtgtcggtcgcacggcgtgtgtctccggccgcgggttccgcctcctcccctgccgccgctgctcacggtgtaagtcaatgtgaagcagcagctccagccccgggataaacatggcgacgtctctgcatgagggacccacgaaccagctggatctgctcatccgggccgtggaagcatcagttcacagcagtaatgcacactgtacagataagacaattgaagctgctgaagccctgcttcatatggaatctcctacctgcttgagggattcaagaagtcctgaattcatccatgctgctatgaggccagatgtcattacagaaactgtagtggaggtgtcaactgaagagtctgaacccatggatacctctcctattccaacatcaccagatagccatgaaccaatgaaaaagaaaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaagcagctcactacgatatcaagttacactaagacttggaacactaacattctgtaagaggttatatagttttcagtgggaggggttgggatgggtaatctcattgttacatatagcaatttttgatgcattttatatgcataccagcaattattactgtgttcgcacagttctcacttaactggtgctatgtgaagactctgctaatataggtattttagaatgtgaattgaagaatggatcccaaaaacttcagaaagaggatagcaaaaaaagatctagtgcgatttatatatatatatatatatatatacatacatatatatatatcatatagcttaagctgatttaaaacaaaggccttagactaattttcgattttctttcttgaaataagctaatggcttgtttgtgtaaagcttttttattaaaagaaaaattttaaaaatcttgtacctagcacagtattgttatagaatatacatgtaacattttatatggtagtttaagtctgtcagtttcttaattgtggacaaattaacagttggctctggccttttgctgtaacatgcctgtgtcactcacttagccttggcatttgtgcagacataccattttcagttctgctgtcacttggaagttcaggctcagcatgaatttttggcaggtagctctaatacctggagttttctttgtttttttttcttttttttagttgaagtttatgagggaaataccagtgttcagttttgaactataatagtttgtatattcaacatttgaagtatattctattttgttgtactcttgtttcaaagtgtattcaagtaggttttctgaaatatagaaatgaaattta

SEQ ID NO: 369094 - DNA, 3535 bp, Homo sapiens
tgattctcctgcctcagcctctcaagtagctgggattacaggcacccgccaccacgcccagctaattgttttgtatttttagtagagacggggtttcaccatgttggtcaggctggtctccaactgctgacctcgtgatccacctgcctcggcctcccaaagtgctggaatatacaggcgtgagccaccgcacctggcacagttatatttatctcctagaatatgaatatcataatactacctatgtacaattgcttgttaagaacttaattcagtatgttcatgaacttgattactaactcttaagaagcagaatgttcattactgccctcttttgacacggggatgttaagcctgtcttctttttcttagttaagtgttaaaattagattgcacaataagttatgctttatttatgtccttcctgtaatttttaaaataacttttcaaattcttcctctttttaggctttctggttaatcatctttagaagactggatttctggatatctactccactccatctctattgacttttaaaacatgataatgcaaacctataacactggcaaccatcagtgaacctttaatttcattgattaatagcgtttgaagcttcctcagggaataacaatgacatcagcagtggttgacagtggaggtactattttggagctttccagcaatggagtagaaaatcaagaggaaagtgaaaaggtttctgaatatccagcagtgattgtggagccagttccaagtgccagattagagcagggctatgcagcccaggttctggtttatgatgatgagacttatatgatgcaagatgtggcagaagaacaagaagttgagaccgagaatgtggaaacagtggaagcatcagttcacagcagtaatgcacactgtacagataagacaattgaagctgctgaagccctgcttcatatggaatctcctacctgcttgagggattcaagaagtcctgtggaagtgtttgttcctccttgtgtatcaactccagaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaagcagctcactacgatatcaagttacactaagacttggaacactaacattctgtaagaggttatatagttttcagtgggaggggttgggatgggtaatctcattgttacatatagcaatttttgatgcattttatatgcataccagcaattattactgtgttcgcacagttctcacttaactggtgctatgtgaagactctgctaatataggtattttagaatgtgaattgaagaatggatcccaaaaacttcagaaagaggatagcaaaaaaagatctagtgcgatttatatatatatatatatatatatacatacatatatatatatcatatagcttaagctgatttaaaacaaaggccttagactaattttcgattttctttcttgaaataagctaatggcttgtttgtgtaaagcttttttattaaaagaaaaattttaaaaatcttgtacctagcacagtattgttatagaatatacatgtaacattttatatggtagtttaagtctgtcagtttcttaattgtggacaaattaacagttggctctggccttttgctgtaacatgcctgtgtcactcacttagccttggcatttgtgcagacataccattttcagttctgctgtcacttggaagttcaggctcagcatgaatttttggcaggtagctctaatacctggagttttctttgtttttttttcttttttttagttgaagtttatgagggaaataccagtgttcagttttgaactataatagtttgtatattcaacatttgaagtatattctattttgttgtactcttgtttcaaagtgtattcaagtaggttttctgaaatatagaaatgaaattta

SEQ ID NO: 369095 - DNA, 3489 bp, Homo sapiens
gccgccgtcgcctaggcggttgggggtcggtggggcggcgcgggcgggggtcgctgcgcggggcggcgagcctctgttttgtctccttctctccctgtggagcggctcgggctgctggggaggccccggctccctccggacgctcggccaacggcggcggctagtccgcggccctgctgagagggaaaaggacgccgcggtcttcccaggcgtcgcggagagcagttccaaagaactactggttcagattttagctcttcccaagttgtgaaaatagtgaaggatgcttagactacttaacatacaaactgctttctggttaatcatctttagaagactggatttctggatatctactccactccatctctattgacttttaaaacatgataatgcaaacctataacactggcaaccatcagtgaacctttaatttcattgattaatagcgtttgaagcttcctcagggaataacaatgacatcagcagtggttgacagtggaggtactattttggagctttccagcaatggagtagaaaatcaagaggaaagtgaaaaggtttctgaatatccagcagtgattgtggagccagttccaagtgccagattagagcagggctatgcagcccaggttctggtttatgatgatgagacttatatgatgcaagatgtggcagaagaacaagaagttgagaccgagaatgtggaaacagtggaagcatcagttcacagcagtaatgcacactgtacagataagacaattgaagctgctgaagccctgcttcatatggaatctcctacctgcttgagggattcaagaagtcctgaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaagcagctcactacgatatcaagttacactaagacttggaacactaacattctgtaagaggttatatagttttcagtgggaggggttgggatgggtaatctcattgttacatatagcaatttttgatgcattttatatgcataccagcaattattactgtgttcgcacagttctcacttaactggtgctatgtgaagactctgctaatataggtattttagaatgtgaattgaagaatggatcccaaaaacttcagaaagaggatagcaaaaaaagatctagtgcgatttatatatatatatatatatatatacatacatatatatatatcatatagcttaagctgatttaaaacaaaggccttagactaattttcgattttctttcttgaaataagctaatggcttgtttgtgtaaagcttttttattaaaagaaaaattttaaaaatcttgtacctagcacagtattgttatagaatatacatgtaacattttatatggtagtttaagtctgtcagtttcttaattgtggacaaattaacagttggctctggccttttgctgtaacatgcctgtgtcactcacttagccttggcatttgtgcagacataccattttcagttctgctgtcacttggaagttcaggctcagcatgaatttttggcaggtagctctaatacctggagttttctttgtttttttttcttttttttagttgaagtttatgagggaaataccagtgttcagttttgaactataatagtttgtatattcaacatttgaagtatattctattttgttgtactcttgtttcaaagtgtattcaagtaggttttctgaaatatagaaatgaaatttatcttctgttttggtctctggtgatattttaaacaatatttaaaagtcagtatagaagtgttttagttaggaagtgataaaacatctctcttctccttcccaactactgcatgaagaaattctacttccattatattaatatttgggc

SEQ ID NO: 369096 - DNA, 2644 bp, Homo sapiens
cgcggggcggaaggatcgcgttgccagctgcggcggccgccacagccacagccgccgccgccgccgccgccgcccctgcccctgccgcccctgcccctgccgttaggtggtggggtttctcagcccggcggcgggaggcgggccggcctcggcttcctgtcggaggacgcgcaaggatccgggcgtcggagtgtgtgcgagtgcgtgagtgtgtgtcggtcgcacggcgtgtgtctccggccgcgggttccgcctcctcccctgccgccgctgctcacggtgtaagtcaatgtgaagcagcagctccagccccgggataaacatggcgacgtctctgcatgagggacccacgaaccagctggatctgctcatccgggccgtggaagcatcagttcacagcagtaatgcacactgtacagataagacaattgaagctgctgaagccctgcttcatatggaatctcctacctgcttgagggattcaagaagtcctgaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaagcagctcactacgatatcaagttacactaagacttggaacactaacattctgtaagaggttatatagttttcagtgggaggggttgggatgggtaatctcattgttacatatagcaatttttgatgcattttatatgcataccagcaattattactgtgttcgcacagttctcacttaactggtgctatgtgaagactctgctaatataggtattttagaatgtgaattgaagaatggatcccaaaaacttcagaaagaggatagcaaaaaaagatctagtgcgatttatatatatatatatatatatatacatacatatatatatatcatatagcttaagctgatttaaaacaaaggccttagactaattttcgattttctttcttgaaataagctaatggcttgtttgtgtaaagcttttttattaaaagaaaaattttaaaaatcttgtacctagcacagtattgttatagaatatacatgtaacatttt

SEQ ID NO: 369097 - DNA, 3489 bp, Homo sapiens
cgcggggcggaaggatcgcgttgccagctgcggcggccgccacagccacagccgccgccgccgccgccgccgcccctgcccctgccgcccctgcccctgccgttaggtggtggggtttctcagcccggcggcgggaggcgggccggcctcggcttcctgtcggaggacgcgcaaggatccgggcgtcggagtgtgtgcgagtgcgtgagtgtgtgtcggtcgcacggcgtgtgtctccggccgcgggttccgcctcctcccctgccgccgctgctcacggtgtaagtcaatgtgaagcagcagctccagccccgggataaacatggcgacgtctctgcatgagggacccacgaaccagctggatctgctcatccgggccgtggaagcatcagttcacagcagtaatgcacactgtacagataagacaattgaagctgctgaagccctgcttcatatggaatctcctacctgcttgagggattcaagaagtcctgaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaagcagctcactacgatatcaagttacactaagacttggaacactaacattctttcctgataatgcatcagtgaaggatccaatctcctgcagtgataactagaaaggataactcgagagtttcactggattttttccagtccccttaactcatagtaacataccaatcatatgttggtgtttccaaaactgatttcgtctggtggcatgcccatgcacccatatgcccaccctcaactcataccctgttaattttgttggtagacaacacttgaaactcagacattattttggccttcattcttatccagatttatttatttaaggctgccatggtttctcttccggttgaagtattttggggtaggtaaacaatgtacctgcaataatgagtattctaatcagtattgttctcaacaacatatgactagcaattagtcatgctaaaatctgaaccaattctacatttggtagatgttcccgtgcttgtcattctttccagtagccccaaaattctgtgcatactatgttacttctgaaaacctcatttgttttaaaagtggttctattaaagaatgagtgatccatttcagtggacgttgttgcagctacagatctatgtacgttcacttttacagtgaaggctccatgtgtgaatggatatatgtgggtcattatgataaaacagtattaaaggagaaaatctactcccagattctttttggactacaaagacattaaaagcactaggtttaaaagaccatttattaatcttatgtatttacaactcacaaattaaaatatctattaccaataagttattttgtttggaagaggctttacctgtaatttttacttttatttctgatggaagagaattccaggtttttttgagatggagtttcactcttgttgcccaggctagagcacaataatggaacatagaggcaggacaaggattatttttgaagaatgtatcaaagaaatctgacatttaaataacaaaagcccctccaggctaaatagttcctttgtactcattttgttatagcccaaatgaaaatattttaaagctttatgaaaatcaccataaattactttctctataacttctcttgcatggttctaaaatgttcataatgctataatttacttaattttatatgaagatataaaaaataaatactgccatgcattttgttgacattttaaaaacccacaaataaataacttaaaatgctgtttagagaaattgctcctacatactattatggaagattcaagcaacaagtctaagtttttatagcatcctcaaattgaaaaagcttcaaaataaccga

SEQ ID NO: 369098 - DNA, 2148 bp, Homo sapiens
  misc_feature (2129)..(2129): n is a, c, g, or t
cgcggggcggaaggatcgcgttgccagctgcggcggccgccacagccacagccgccgccgccgccgccgccgcccctgcccctgccgcccctgcccctgccgttaggtggtggggtttctcagcccggcggcgggaggcgggccggcctcggcttcctgtcggaggacgcgcaaggatccgggcgtcggagtgtgtgcgagtgcgtgagtgtgtgtcggtcgcacggcgtgtgtctccggccgcgggttccgcctcctcccctgccgccgctgctcacggtgtaagtcaatgtgaagcagcagctccagccccgggataaacatggcgacgtctctgcatgagggacccacgaaccagctggatctgctcatccgggccgtggaagcatcagttcacagcagtaatgcacactgtacagataagacaattgaagctgctgaagccctgcttcatatggaatctcctacctgcttgagggattcaagaagtcctgaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcacgaanggttttccaagtaagagcc

SEQ ID NO: 369099 - DNA, 1456 bp, Homo sapiens
cgcggggcggaaggatcgcgttgccagctgcggcggccgccacagccacagccgccgccgccgccgccgccgcccctgcccctgccgcccctgcccctgccgttaggtggtggggtttctcagcccggcggcgggaggcgggccggcctcggcttcctgtcggaggacgcgcaaggatccgggcgtcggagtgtgtgcgagtgcgtgagtgtgtgtcggtcgcacggcgtgtgtctccggccgcgggttccgcctcctcccctgccgccgctgctcacggtgtaagtcaatgtgaagcagcagctccagccccgggataaacatggcgacgtctctgcatgagggacccacgaaccagctggatctgctcatccgggccgtggaagcatcagttcacagcagtaatgcacactgtacagataagacaattgaagctgctgaagccctgcttcatatggaatctcctacctgcttgagggattcaagaagtcctgaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggttttttggggaaaacaaacaaaaaacagccaaacatccaagtgtggtctcctgatcagcaatatcagcatcacctgggattgtgatccccaaattgtgagctaacgtgtcccagggaaccacagcaaactcacagggacaccatggtatattttatattttaaatgtgaaataaacagtgacgtttgacacc

SEQ ID NO: 369100 - DNA, 1982 bp, Homo sapiens
tcggccgcctactactactaaattaacggccggtcgacgtgtatgggaaaatagaaaaataaaaaccagaaacaatagtatatagggtataataggaaaagcagaatgaaaggtacatatggatggaataagggatctatgcaaggaacatgcaacttagggtggggcacagtggctcatggctgtaatcccagcactttgggaggtggaggtaggaggatcacttgaacccaggagtttgggaccagcctgggcaatgtgatgaaaccccatctctacaaaaaagtaaaaaattttagctgggcatggtttcacgtgcctgtggtcccagcagctcgggagactgaggtgggaggatcactggagcccgtggggtagactacagtgagccatgatcacaccactgcactgcagcctgggtgacagagcaataccgtatctcaaaagaaaagaaaaaagcaacctattaagatttatatactactaaaaaattattagaaggctcacatatgactttaaaaaaattttctttttcagttcctgataatgcatcagtgaaggatccaatctcctgcagtgataactagaaaggataactcgagagtttcactggattttttccagtccccttaactcatagtaacataccaatcatatgttggtgtttccaaaactgatttcgtctggtggcatgcccatgcacccatatgcccaccctcaactcataccctgttaattttgttggtagacaacacttgaaactcagacattattttggccttcattcttatccagatttatttatttaaggctgccatggtttctcttccggttgaagtattttggggtaggtaaacaatgtacctgcaataatgagtattctaatcagtattgttctcaacaacatatgactagcaattagtcatgctaaaatctgaaccaattctacatttggtagatgttcccgtgcttgtcattctttccagtagccccaaaattctgtgcatactatgttacttctgaaaacctcatttgttttaaaagtggttctattaaagaatgagtgatccatttcagtggacgttgttgcagctacagatctatgtacgttcacttttacagtgaaggctccatgtgtgaatggatatatgtgggtcattatgataaaacagtattaaaggagaaaatctactcccagattctttttggactacaaagacattaaaagcactaggtttaaaagaccatttattaatcttatgtatttacaactcacaaattaaaatatctattaccaataagttattttgtttggaagaggctttacctgtaatttttacttttatttctgatggaagagaattccaggtttttttgagatggagtttcactcttgttgcccaggctagagcgcaatggtgcagtctgggttcactgcaacctctacctcccaggttcaagcgattctcctgtttcagcctcccaagtagctgggattacagacacctgccaccatgcccagctaatttttgtatttttagtagagacgaggtttcaccatgttggccaggctggtttcgaactcctgaccacagttgatccgcccaccttggcctccgaaagtgctgggattacaagcatgagccaccacacccgacccaggttatctaactttttacattcttctttctagatattttgaatgacagtatctggctatcttaggaaatttcaatgaaagcccattaacaggctttctagaaagtttcctatctctgaaaagaaggtcctactgactctcttggccactgccacatacagcttctaaataacctattgtgaatagcacattccaatacaaataatgatgacatcgagtgactaatatcaaacgcataccaatattattccaatggtaaagtttaaatataacagcaataatgaaaactaattggttaaataattgaaaactaattggaatc

SEQ ID NO: 369101 - DNA, 1650 bp, Homo sapiens
tgattctcctgcctcagcctctcaagtagctgggattacaggcacccgccaccacgcccagctaattgttttgtatttttagtagagacggggtttcaccatgttggtcaggctggtctccaactgctgacctcgtgatccacctgcctcggcctcccaaagtgctggaatatacaggcgtgagccaccgcacctggcacagttatatttatctcctagaatatgaatatcataatactacctatgtacaattgcttgttaagaacttaattcagtatgttcatgaacttgattactaactcttaagaagcagaatgttcattactgccctcttttgacacggggatgttaagcctgtcttctttttcttagttaagtgttaaaattagattgcacaataagttatgctttatttatgtccttcctgtaatttttaaaataacttttcaaattcttcctctttttaggctttctggttaatcatctttagaagactggatttctggatatctactccactccatctctattgacttttaaaacatgataatgcaaacctataacactggcaaccatcagtgaacctttaatttcattgattaatagcgtttgaagcttcctcagggaataacaatgacatcagcagtggttgacagtggaggtactattttggagctttccagcaatggagtagaaaatcaagaggaaagtgaaaaggtttctgaatatccagcagtgattgtggagccagttccaagtgccagattagagcagggctatgcagcccaggttctggtttatgatgatgagacttatatgatgcaagatgtggcagaagaacaagaagttgagaccgagaatgtggaaacaggtagacatctcataaaatgttcattatttataactttctcattttgtaagcttcaacaatactattgccagatgaaaaatatactgaaaaacctttttaatgctatttagtatagcttggaaaccagtgaaacatctatgtttaagggaatttgtgtagatataaaacttctattgtataattctatgaggtgtaacagtctcatatcatggactctatgcacaaaattacagcttcacataatgataaagttattttattattttttttctgagagtataaatcctagctgttatttatacaagtcaataggctagtattatgaggacagctttttaaattaaaaaaaatggtattctatcattgtctaattgattatgagtttctttgagttaatattgatggagcaataagatttcttttcattaatatcagaagcatcattgtagtgttctatcagtttcctctttgctttttgtcgtcttagagatcttagtatttcagtctatttctggtgagatagctatatgtttaattggagattagtatctataattcttagagaaatcttttagtttttgccattgattatgaagaaaatagagtattttatcagaaggattgtagtgactcttacataataataaacatgcaaatgtatcatctttagctgttaatggagaaaaagaatcattatacttgttgtttaatcctagtaaaaattctttactattttgatacatttttataaatgtaggaaactttcatgattaaaattt

SEQ ID NO: 369102 - DNA, 991 bp, Homo sapiens
tgattctcctgcctcagcctctcaagtagctgggattacaggcacccgccaccacgcccagctaattgttttgtatttttagtagagacggggtttcaccatgttggtcaggctggtctccaactgctgacctcgtgatccacctgcctcggcctcccaaagtgctggaatatacaggcgtgagccaccgcacctggcacagttatatttatctcctagaatatgaatatcataatactacctatgtacaattgcttgttaagaacttaattcagtatgttcatgaacttgattactaactcttaagaagcagaatgttcattactgccctcttttgacacggggatgttaagcctgtcttctttttcttagttaagtgttaaaattagattgcacaataagttatgctttatttatgtccttcctgtaatttttaaaataacttttcaaattcttcctctttttaggctttctggttaatcatctttagaagactggatttctggatatctactccactccatctctattgacttttaaaacatgataatgcaaacctataacactggcaaccatcagtgaacctttaatttcattgattaatagcgtttgaagcttcctcagggaataacaatgacatcagcagtggttgacagtggaggtactattttggagctttccagcaatggagtagaaaatcaagaggttaggcattcaatgaattacatttctattttcttcatagaaatttgtgcatgaactaattttgaaattaataggaaacatatttgagagtaaaaatgtacaaagcatgaaattatacatgtacatgtcgtgtatccttatataatttaggtaatagaaggtcaaggaaggtattgcagggcttacgtgaattgttggaacatacatatattagaatgaacttggagggaggaaaggaatggaaagaacactatagtattagttgagagttaaatttaaatccctc

SEQ ID NO: 369103 - DNA, 327 bp, Homo sapiens
ttggccgtaaaccaaagacccagcaatcaccaatttccaatgggtctcctgagttaggtataaagaagaaaccaagagaaggaaaaggtaatttggggagggttgctttggaagtgagatgattttttttcagttaggtgacatttttgtatttgtaagaaaactatttctagtacatgcacatatgagaatactgtcgctggtaatagttcttaataagggatgtatcagcatcacgtggggagctttttcaaaatatctgtgcccagttcctacaccacagagattctgtaaccatagttgtatcatgggggatatagggacttg

SEQ ID NO: 369104 - DNA, 768 bp, Homo sapiens
cgcggggcggaaggatcgcgttgccagctgcggcggccgccacagccacagccgccgccgccgccgccgccgcccctgcccctgccgcccctgcccctgccgttaggtggtggggtttctcagcccggcggcgggaggcgggccggcctcggcttcctgtcggaggacgcgcaaggatccgggcgtcggagtgtgtgcgagtgcgtgagtgtgtgtcggtcgcacggcgtgtgtctccggccgcgggttccgcctcctcccctgccgccgctgctcacggtgtaagtcaatgtgaagcagcagctccagccccgggataaacatggcgacgtctctgcatgagggacccacgaaccagctggatctgctcatccgggccggtaaggacaggggaacttttctcccgtgcatcggtgcagcaggagagggggtgcacagaaggcggggtgactcccctgtagcagtctgtgctgggggtacagtgtccacctcacagtcactggggcggctgggggaaaggggggagtgaatgaagtaatggaggcgacgaatcaggaagtgatcaccttggagagtaacctgcctcgaatccggcgctgtcgcttcagggtgggttcggcgagcagcagcagcagctgccgggctgagcgctggcagcgggtgctggagaacggagccgcggttaagttggcactcgggggcggacgagttgtgcgcttcaccccagttgctgaggaaccaggaagtgagtgaggctgttgtctctcg

SEQ ID NO: 369105 - DNA, 544 bp, Homo sapiens
cgcggggcggaaggatcgcgttgccagctgcggcggccgccacagccacagccgccgccgccgccgccgccgcccctgcccctgccgcccctgcccctgccgttaggtggtggggtttctcagcccggcggcgggaggcgggccggcctcggcttcctgtcggaggacgcgcaaggatccgggcgtcggagtgtgtgcgagtgcgtgagtgtgtgtcggtcgcacggcgtgtgtctccggccgcgggttccgcctcctcccctgccgccgctgctcacggtgtaagtcaatgtgaagcagcagctccagccccgggataaacatggcgacgtctctgcatgagggacccacgaaccagctggatctgctcatccgggccgtggaagcatcagttcacagcagactcccccaacccgatccccacagtcaacgcccgtaccctgggggcgggcggagggggcggcggcagccgacggaagaggcgggcggctggactaaacaaggtcaactgcagagtatttatgcatggggttgtaaggaagga

SEQ ID NO: 369106 - DNA, 3008 bp, Homo sapiens
cgcggggcggaaggatcgcgttgccagctgcggcggccgccacagccacagccgccgccgccgccgccgccgcccctgcccctgccgcccctgcccctgccgttaggtggtggggtttctcagcccggcggcgggaggcgggccggcctcggcttcctgtcggaggacgcgcaaggatccgggcgtcggagtgtgtgcgagtgcgtgagtgtgtgtcggtcgcacggcgtgtgtctccggccgcgggttccgcctcctcccctgccgccgctgctcacggtgtaagtcaatgtgaagcagcagctccagccccgggataaacatggcgacgtctctgcatgagggacccacgaaccagctggatctgctcatccgggccgtggaagcatcagttcacagcagtaatgcacactgtacagataagacaattgaagctgctgaagccctgcttcatatggaatctcctacctgcttgagggattcaagaagtcctgaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaagcagctcactacgatatcaagttacactaagacttggaacactaacattctgtaagaggttatatagttttcagtgggaggggttgggatgggtaatctcattgttacatatagcaatttttgatgcattttatatgcataccagcaattattactgtgttcgcacagttctcacttaactggtgctatgtgaagactctgctaatataggtattttagaatgtgaattgaagaatggatcccaaaaacttcagaaagaggatagcaaaaaaagatctagtgcgatttatatatatatatatatatatatacatacatatatatatatcatatagcttaagctgatttaaaacaaaggccttagactaattttcgattttctttcttgaaataagctaatggcttgtttgtgtaaagcttttttattaaaagaaaaattttaaaaatcttgtacctagcacagtattgttatagaatatacatgtaacattttatatggtagtttaagtctgtcagtttcttaattgtggacaaattaacagttggctctggccttttgctgtaacatgcctgtgtcactcacttagccttggcatttgtgcagacataccattttcagttctgctgtcacttggaagttcaggctcagcatgaatttttggcaggtagctctaatacctggagttttctttgtttttttttcttttttttagttgaagtttatgagggaaataccagtgttcagttttgaactataatagtttgtatattcaacatttgaagtatattctattttgttgtactcttgtttcaaagtgtattcaagtaggttttctgaaatatagaaatgaaattta

SEQ ID NO: 369107 - DNA, 3499 bp, Homo sapiens
tgattctcctgcctcagcctctcaagtagctgggattacaggcacccgccaccacgcccagctaattgttttgtatttttagtagagacggggtttcaccatgttggtcaggctggtctccaactgctgacctcgtgatccacctgcctcggcctcccaaagtgctggaatatacaggcgtgagccaccgcacctggcacagttatatttatctcctagaatatgaatatcataatactacctatgtacaattgcttgttaagaacttaattcagtatgttcatgaacttgattactaactcttaagaagcagaatgttcattactgccctcttttgacacggggatgttaagcctgtcttctttttcttagttaagtgttaaaattagattgcacaataagttatgctttatttatgtccttcctgtaatttttaaaataacttttcaaattcttcctctttttaggctttctggttaatcatctttagaagactggatttctggatatctactccactccatctctattgacttttaaaacatgataatgcaaacctataacactggcaaccatcagtgaacctttaatttcattgattaatagcgtttgaagcttcctcagggaataacaatgacatcagcagtggttgacagtggaggtactattttggagctttccagcaatggagtagaaaatcaagaggaaagtgaaaaggtttctgaatatccagcagtgattgtggagccagttccaagtgccagattagagcagggctatgcagcccaggttctggtttatgatgatgagacttatatgatgcaagatgtggcagaagaacaagaagttgagaccgagaatgtggaaacagtggaagcatcagttcacagcagtaatgcacactgtacagataagacaattgaagctgctgaagccctgcttcatatggaatctcctacctgcttgagggattcaagaagtcctgaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaagcagctcactacgatatcaagttacactaagacttggaacactaacattctgtaagaggttatatagttttcagtgggaggggttgggatgggtaatctcattgttacatatagcaatttttgatgcattttatatgcataccagcaattattactgtgttcgcacagttctcacttaactggtgctatgtgaagactctgctaatataggtattttagaatgtgaattgaagaatggatcccaaaaacttcagaaagaggatagcaaaaaaagatctagtgcgatttatatatatatatatatatatatacatacatatatatatatcatatagcttaagctgatttaaaacaaaggccttagactaattttcgattttctttcttgaaataagctaatggcttgtttgtgtaaagcttttttattaaaagaaaaattttaaaaatcttgtacctagcacagtattgttatagaatatacatgtaacattttatatggtagtttaagtctgtcagtttcttaattgtggacaaattaacagttggctctggccttttgctgtaacatgcctgtgtcactcacttagccttggcatttgtgcagacataccattttcagttctgctgtcacttggaagttcaggctcagcatgaatttttggcaggtagctctaatacctggagttttctttgtttttttttcttttttttagttgaagtttatgagggaaataccagtgttcagttttgaactataatagtttgtatattcaacatttgaagtatattctattttgttgtactcttgtttcaaagtgtattcaagtaggttttctgaaatatagaaatgaaattta

SEQ ID NO: 369108 - DNA, 2926 bp, Homo sapiens
gccgccgtcgcctaggcggttgggggtcggtggggcggcgcgggcgggggtcgctgcgcggggcggcgagcctctgttttgtctccttctctccctgtggagcggctcgggctgctggggaggccccggctccctccggacgctcggccaacggcggcggctagtccgcggccctgctgagagggaaaaggacgccgcggtcttcccaggcgtcgcggagagcagttccaaagaactactggttcagattttagctcttcccaagttgtgaaaatagtgaaggatgcttagactacttaacatacaaactgctttctggttaatcatctttagaagactggatttctggatatctactccactccatctctattgacttttaaaacatgataatgcaaacctataacactggcaaccatcagtgaacctttaatttcattgattaatagcgtttgaagcttcctcagggaataacaatgacatcagcagtggttgacagtggaggtactattttggagctttccagcaatggagtagaaaatcaagaggaaagtgaaaaggtttctgaatatccagcagtgattgtggagccagttccaagtgccagattagagcagggctatgcagcccaggttctggtttatgatgatgagacttatatgatgcaagatgtggcagaagaacaagaagttgagaccgagaatgtggaaacagtggaagcatcagttcacagcagtaatgcacactgtacagataagacaattgaagctgctgaagccctgcttcatatggaatctcctacctgcttgagggattcaagaagtcctgaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaagcagctcactacgatatcaagttacactaagacttggaacactaacattctgtaagaggttatatagttttcagtgggaggggttgggatgggtaatctcattgttacatatagcaatttttgatgcattttatatgcataccagcaattattactgtgttcgcacagttctcacttaactggtgctatgtgaagactctgctaatataggtattttagaatgtgaattgaagaatggatcccaaaaacttcagaaagaggatagcaaaaaaagatctagtgcgatttatatatatatatatatatatatacatacatatatatatatcatatagcttaagctgatttaaaacaaaggccttagactaattttcgattttctttcttgaaataagctaatggcttgtttgtgtaaagcttttttattaaaagaaaaatttt

SEQ ID NO: 369109 - DNA, 3647 bp, Homo sapiens
cgcggggcggaaggatcgcgttgccagctgcggcggccgccacagccacagccgccgccgccgccgccgccgcccctgcccctgccgcccctgcccctgccgttaggtggtggggtttctcagcccggcggcgggaggcgggccggcctcggcttcctgtcggaggacgcgcaaggatccgggcgtcggagtgtgtgcgagtgcgtgagtgtgtgtcggtcgcacggcgtgtgtctccggccgcgggttccgcctcctcccctgccgccgctgctcacggtgtaagtcaatgtgaagcagcagctccagccccgggataaacatggcgacgtctctgcatgagggacccacgaaccagctggatctgctcatccgggccgtggaagcatcagttcacagcagtaatgcacactgtacagataagacaattgaagctgctgaagccctgcttcatatggaatctcctacctgcttgagggattcaagaagtcctgaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaagcagctcactacgatatcaagttacactaagacttggaacactaacattctttcctgataatgcatcagtgaaggatccaatctcctgcagtgataactagaaaggataactcgagagtttcactggattttttccagtccccttaactcatagtaacataccaatcatatgttggtgtttccaaaactgatttcgtctggtggcatgcccatgcacccatatgcccaccctcaactcataccctgttaattttgttggtagacaacacttgaaactcagacattattttggccttcattcttatccagatttatttatttaaggctgccatggtttctcttccggttgaagtattttggggtaggtaaacaatgtacctgcaataatgagtattctaatcagtattgttctcaacaacatatgactagcaattagtcatgctaaaatctgaaccaattctacatttggtagatgttcccgtgcttgtcattctttccagtagccccaaaattctgtgcatactatgttacttctgaaaacctcatttgttttaaaagtggttctattaaagaatgagtgatccatttcagtggacgttgttgcagctacagatctatgtacgttcacttttacagtgaaggctccatgtgtgaatggatatatgtgggtcattatgataaaacagtattaaaggagaaaatctactcccagattctttttggactacaaagacattaaaagcactaggtttaaaagaccatttattaatcttatgtatttacaactcacaaattaaaatatctattaccaataagttattttgtttggaagaggctttacctgtaatttttacttttatttctgatggaagagaattccaggtttttttgagatggagtttcactcttgttgcccaggctagagcgcaatggtgcagtctgggttcactgcaacctctacctcccaggttcaagcgattctcctgtttcagcctcccaagtagctgggattacagacacctgccaccatgcccagctaatttttgtatttttagtagagacgaggtttcaccatgttggccaggctggtttcgaactcctgaccacagttgatccgcccaccttggcctccgaaagtgctgggattacaagcatgagccaccacacccgacccaggttatctaactttttacattcttctttctagatattttgaatgacagtatctggctatcttaggaaatttcaatgaaagcccattaacaggctttctagaaagtttcctatctctgaaaagaaggtcctactgactctcttggccactgccacatacagcttctaaataacctattgtgaatagcacattccaatacaaataatgatgacatcgagtgactaatatcaaacgcataccaatattattccaatggtaaagtttaaatataacagcaataatgaaaactaattggttaaataattgaaaactaattggaatc

SEQ ID NO: 369110 - DNA, 1501 bp, Homo sapiens
cgcggggcggaaggatcgcgttgccagctgcggcggccgccacagccacagccgccgccgccgccgccgccgcccctgcccctgccgcccctgcccctgccgttaggtggtggggtttctcagcccggcggcgggaggcgggccggcctcggcttcctgtcggaggacgcgcaaggatccgggcgtcggagtgtgtgcgagtgcgtgagtgtgtgtcggtcgcacggcgtgtgtctccggccgcgggttccgcctcctcccctgccgccgctgctcacggtgtaagtcaatgtgaagcagcagctccagccccgggataaacatggcgacgtctctgcatgagggacccacgaaccagctggatctgctcatccgggccgtggaagcatcagttcacagcagtaatgcacactgtacagataagacaattgaagctgctgaagccctgcttcatatggaatctcctacctgcttgagggattcaagaagtcctgaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggtggcagtcacagaccagacaagaaagctgaagcgtcatccagacaagactgaaccataccttcagccaggacagactcatatggaaaagctctctaaagagaagggaatcccctccatgataaatgcttagtttaacatgttcgactggtgctcaattgtctattggctgacaaatcatttccacaagctgggcttttctagcacaatcctctgaaataaaaatgtgaaaaagcaaa

SEQ ID NO: 369111 - DNA, 1199 bp, Homo sapiens
cgcagtggttcacgcctgtaatgccagcactgggaggccgaggcaggtggatcacgaggtcaggagatcgagaccatcctggctatcatggtgaaaccccatctctactaaaaataaaaataaaaaaattagccgggcatggtggcgggggcctgtagtcccagctactcaggaggctgaggcaggagaatggcatgaacctgggaggcggagcttgcagtgagctgagattgcgccactgcactccagcctgggcgacagagcgagactccatttcaagaaaaattaaaaaactgtttgttgcctgcttgttttaatgttctggcttgaggcagcgagcccttgactatgccacattgccaggattttgcaggttagattgtactacagcactgcctttggcttgccagactctggagtccccacattttcatcctgttctcaggaaaacactttgacccacttgaagctctgagctactgcttcacagcttcctggggtcagtctccagccaaaaccatagatatcccaactgcagccaaaccacggctctgggcgaaggaacgattaggtttactctaggtttccacaccctgatgctcctgcctttactttgacacctctgactgccaggttttcacagacctgttgacagtgactcaagatctggaatgtaatggatggtttggcaacagtgtttgcttgagcagtttaaaatctggccagggagactcaatgtgagcaagaaaatgatagaataccaagttttctggaggtcagagggagctgagttgagtgttacagagaatgctgtggggtttgagatgagaaaaatagcttgctaatttaaaagacggattatttttccctaaagaccttgacttatgtaaatgtatattatccataattttaaaaatccacttatggctgggcacagaagctcacacctgtaatcccagcactttgggaggctgaggcaggaggatcagttgagtccaggagttcgagaccagcctgggcaacatggtgaaaccctgtatctacaaaacatagaaaaactagttgggtgtggtggtgtgtacctgtagttccagctactagggaggtaggaagatcacctgagcccatggagattgaggctgtggtgagctgtgaaggcaccacagcactctggcctgggcaagagtgggactctctca

SEQ ID NO: 369112 - DNA, 804 bp, Homo sapiens
ggtcttagaggaaaaaactacagtttgtcttggagggagcctcctcttgctaagacccccaccaccagggctaaggattgcttaaatcagtggtgttcaaacctggttctgagctgccttctcaggggctgaggatagggacaggaccagaccctggggctctcacccccagcctgggcctgagcagcttcttgcttatctgcttgatgtcctaggcttctagagaaggtttcattttgaacaaagagttatagggctgaagaaaaagttgaaaagcaccgcctcaaatcgtgttccctctccccagggatagattgctttctgcttccggagcccatcagcgtttgccagtcccagagcaggcctgacactgcagtgtagggaggggcatgggagtccctcaggagaagtgtcgcaggagtgatccttggagcacttgggtgaagggcggatgcacaagatacacagacacctctgggggacacagctttgggctctgagtgttaagtggctcccagagaaatagaggttcgactccgtgctgtttcccttctgtaccctgtgctttctgcctccatgcttctgtccaggctgctttcacccggagcgctcttgtgcatgtccacgccctccttgtcctcaaaggctggctcccatgttacccttccattaagtcctcctgatccccttgaaatcccatagttcttcactttgttcctctttgcatgtgagtccctcccagaacacagtggcactcaaccccctgggaacaaatgaatgaataaacgaacttaaacaagggca

SEQ ID NO: 369113 - DNA, 3916 bp, Homo sapiens
cctctggcatgttggaacaatgtaggtaaggaaagtcggcaagccggatccgtaacttcgggataaggattggctctaagggctgggtcggtcgggctggggcgcgtaagggccagcagctgctggcccttacgcgcctgctggcacttacgcgccctccatcatcaatcctaaacagagcaaggatgcccccaaaagcttcacctttgactactcctactggtcacacacttcgacggaggacccccagtttgcatctcagcagcaagtgtatcgggacattggagaagagatgctgctccacgcctttgaaggctacaacgtgtgcatctttgcctatgggcagaccggggctgggaaatcctataccatgatggggcgacaggagccagggcagcagggcatcgtgccccagctctgtgaggacctcttctctcgcgttagtgagaaccagagtgctcagctatcctactctgtggaggtgagctatatggagatctactgtgagcgggtacgagacctcttgaaccccaagagtcggggttctctgcgggtccgggagcaccccatcctgggcccgtacgtgcaggacctgtccaaattggctgtgacctcctacgcagacattgctgacctcatggactgtggaaataaagcacggactgtggctgccaccaacatgaatgagaccagcagccgttcccatgccgtctttaccatcgtcttcacacagcgctgccatgaccagctcacggggctggactcggagaaggtcagtaagatcagtttggtggaccttgctgggagtgagcgagccgactcctcaggggcccggggcatgcgcctgaaggaaggagccaacatcaataagtccctgactacactagggaaagtgatctcggcccttgcagatatgcaatcaaagaagcgaaagtcggattttatcccctacagggactctgtgctcacctggctgctcaaggaaaatttgggggggaactcacgcacagccatgattgcagccctgagccctgctgacatcaattacgaggagactctcagcaccctcaggtatgctgaccgcaccaagcaaatccgctgcaatgccatcatcaacgaggaccctaatgcccggctgattagagagctgcaggaggaagtagcccggctgcgggaactgctgatggctcagggactgtcagcctctgctctggaaggcctgaagacggaagaagggagtgtcagaggcgccctgccagctgtgtcatctcccccagctccagtttcaccctcatcacccaccacacataatggggagctggagccgtcattctcccccaacacggagtcccagattgggcctgaggaagccatggagaggctgcaggagacagagaagattatagctgagctgaacgagacatgggaggagaagctacgcaagacagaagccctgaggatggagagagaagcattgctggctgagatgggggtggccgtccgggaggatgggggaactgtgggcgtcttctctccaaagaagactccccacctggtgaacctgaacgaagaccctctgatgtctgagtgtctgctctaccacatcaaagatggcgtcaccagggtcggccaagtagatatggacatcaagctgaccggacagttcattcgggagcaacactgtctgttccggagcatcccccagccagatggagaagtggtggtcactctggagccttgtgaaggagctgagacatatgtgaatgggaagcttgtgacggagccgctggtgctgaagtcagggaataggattgtgatgggcaagaaccacgttttccgcttcaaccacccggagcaggcaaggctggaacgggaacgaggggtccccccacccccaggaccgccctctgagccagtcgactggaactttgcccagaaggaactgctggagcagcaaggcatcgacataaagctggaaatggagaagaggctgcaggatctggagaatcagtaccggaaagaaaaggaagaagccgatcttctgctggagcagcagcgactgtatgcagactcggacagcggggatgactctgacaagcgctcttgtgaagagagctggaggctcatctcctccttgcgggagcagctgccgcccaccacggtccagaccattgtcaaacgctgtggtctgcccagcagtggcaagcgcagggcccctcgcagggtttatcagatcccccagcgacgcaggctgcagggcaaagacccccgctgggccaccatggctgacctgaagatgcaggcggtgaaggagatctgctacgaggtggccctggctgacttccgccacgggcgggctgagattgaggccctggccgccctcaagatgcgggagctgtgtcgcacctatggcaagccagacggccccggagacgcctggagggctgtggcccgggatgtctgggacactgtaggcgaggaggaaggaggtggagctggcagtggtggtggcagtgaggagggagcccgaggggcggaggtggaggacctccgggcccacatcgacaagctgacggggattctgcaggaggtgaagctgcagaacagcagcaaggaccgggagctgcaggccctgcgggaccgcatgctccgcatggagagggtcatccccctggcccaggatcatgaggatgagaatgaagaaggtggtgaggtcccctgggccccgcctgaaggatcagaggcagcagaggaggcagcccccagtgaccgcatgccgtcagcccggcccccctcgccgccactgtcaagctgggagcgggtgtcacggctcatggaggaggaccctgccttccgtcgtggtcgtcttcgctggctcaagcaggagcagctacggctgcagggactgcagggctctgggggccggggcggggggctgcgcaggcccccagcccgctttgtgccccctcacgactgcaagctacgcttccccttcaagagcaacccccagcaccgggagtcttggccagggatggggagcggggaggctccaactccgctccaaccccctgaggaggtcactccccatccagccacccctgcccgccggcctccgagtccccgaaggtcccaccatccccgcaggaactccctggatggagggggccgatcccggggagcgggttctgcacagcctgaaccccagcacttccagcccaaaaagcacaactcttatccccagccaccccaaccctacccagcccagcggcccccagggccccgctaccccccatacactactcccccacgaatgagacggcagcgttctgcccctgacctcaaggagagtggggcagctgtgtgagtcccacatcctgggcagagggcctggtggggccccttgctaggagaagggaagacgcccgagacgctgcttccccagaagtgctggggcagggaggcccaggagatgagagagaaggtccgagtaggtgatagaagacaagggggagaccgagccggaggctgaggaaaggaagagggcacggagttgccaggagcaaaccaaagtgaagagagagataggaagctgcctcggggccaccccttgcaaagggggtgtgtcccacaaacgctgctatgggtggggtggggggctggggtgctgcgtagccagtgtttgactttcttttcaagtgggggaaagtgggagaggactgagagtgaggcaagttctccccagcccctgtccgtctgtctgtctgtctgtggtggtttctgtttcttgggaggcatggtaggatcataagtcattcccctccccttccaggcctcctgctatatttgggggacctgactggtttggctggagtcccatgaggatgtgggccctttaataaaggatagcaaacaggga

SEQ ID NO: 369114 - DNA, 4786 bp, Homo sapiens
cgctcccgccccagctcgcgctgcccgggcgggcgccggccgctggcgccgctactgctgccgcccccggggcgcgagtccgccgcccgccgcccgggcacccggcgaggggcgggggcagctccgaaccggccccagatccttcccgcttccgcctcacgcttcccggaaagcttgtccctctccgccgagctgctccgggagccccgccgcgccgagggtatctcccagagccccagctggtgtggccaggccccaggagtaggatggggctccccctacgagggccggtggcagccagaactgatacagcccccctggtctggggccaggacgccagctgaggagggcaggagtgtctggagctatggctggtgcctcggtgaaagtggcagtgagggttcggccctttaacgcccgtgagaccagccaggatgccaagtgtgtggtcagcatgcagggcaacaccacctccatcatcaatcctaaacagagcaaggatgcccccaaaagcttcacctttgactactcctactggtcacacacttcgacggaggacccccagtttgcatctcagcagcaagtgtatcgggacattggagaagagatgctgctccacgcctttgaaggctacaacgtgtgcatctttgcctatgggcagaccggggctgggaaatcctataccatgatggggcgacaggagccagggcagcagggcatcgtgccccagctctgtgaggacctcttctctcgcgttagtgagaaccagagtgctcagctatcctactctgtggaggtgagctatatggagatctactgtgagcgggtacgagacctcttgaaccccaagagtcggggttctctgcgggtccgggagcaccccatcctgggcccgtacgtgcaggacctgtccaaattggctgtgacctcctacgcagacattgctgacctcatggactgtggaaataaagcacggactgtggctgccaccaacatgaatgagaccagcagccgttcccatgccgtctttaccatcgtcttcacacagcgctgccatgaccagctcacggggctggactcggagaaggtcagtaagatcagtttggtggaccttgctgggagtgagcgagccgactcctcaggggcccggggcatgcgcctgaaggaaggagccaacatcaataagtccctgactacactagggaaagtgatctcggcccttgcagatatgcaatcaaagaagcgaaagtcggattttatcccctacagggactctgtgctcacctggctgctcaaggaaaatttgggggggaactcacgcacagccatgattgcagccctgagccctgctgacatcaattacgaggagactctcagcaccctcaggtatgctgaccgcaccaagcaaatccgctgcaatgccatcatcaacgaggaccctaatgcccggctgattagagagctgcaggaggaagtagcccggctgcgggaactgctgatggctcagggactgtcagcctctgctctggaaggcctgaagacggaagaagggagtgtcagaggcgccctgccagctgtgtcatctcccccagctccagtttcaccctcatcacccaccacacataatggggagctggagccgtcattctcccccaacacggagtcccagattgggcctgaggaagccatggagaggctgcaggagacagagaagattatagctgagctgaacgagacatgggaggagaagctacgcaagacagaagccctgaggatggagagagaagcattgctggctgagatgggggtggccgtccgggaggatgggggaactgtgggcgtcttctctccaaagaagactccccacctggtgaacctgaacgaagaccctctgatgtctgagtgtctgctctaccacatcaaagatggcgtcaccagggtcggccaagtagatatggacatcaagctgaccggacagttcattcgggagcaacactgtctgttccggagcatcccccagccagatggagaagtggtggtcactctggagccttgtgaaggagctgagacatatgtgaatgggaagcttgtgacggagccgctggtgctgaagtcagggaataggattgtgatgggcaagaaccacgttttccgcttcaaccacccggagcaggcaaggctggaacgggaacgaggggtccccccacccccaggaccgccctctgagccagtcgactggaactttgcccagaaggaactgctggagcagcaaggcatcgacataaagctggaaatggagaagaggctgcaggatctggagaatcagtaccggaaagaaaaggaagaagccgatcttctgctggagcagcagcgactgtatgcagactcggacagcggggatgactctgacaagcgctcttgtgaagagagctggaggctcatctcctccttgcgggagcagctgccgcccaccacggtccagaccattgtcaaacgctgtggtctgcccagcagtggcaagcgcagggcccctcgcagggtttatcagatcccccagcgacgcaggctgcagggcaaagacccccgctgggccaccatggctgacctgaagatgcaggcggtgaaggagatctgctacgaggtggccctggctgacttccgccacgggcgggctgagattgaggccctggccgccctcaagatgcgggagctgtgtcgcacctatggcaagccagacggccccggagacgcctggagggctgtggcccgggatgtctgggacactgtaggcgaggaggaaggaggtggagctggcagtggtggtggcagtgaggagggagcccgaggggcggaggtggaggacctccgggcccacatcgacaagctgacggggattctgcaggaggtgaagctgcagaacagcagcaaggaccgggagctgcaggccctgcgggaccgcatgctccgcatggagagggtcatccccctggcccaggatcatgaggatgagaatgaagaaggtggtgaggtcccctgggccccgcctgaaggatcagaggcagcagaggaggcagcccccagtgaccgcatgccgtcagcccggcccccctcgccgccactgtcaagctgggagcgggtgtcacggctcatggaggaggaccctgccttccgtcgtggtcgtcttcgctggctcaagcaggagcagctacggctgcagggactgcagggctctgggggccggggcggggggctgcgcaggcccccagcccgctttgtgccccctcacgactgcaagctacgcttccccttcaagagcaacccccagcaccgggagtcttggccagggatggggagcggggaggctccaactccgctccaaccccctgaggaggtcactccccatccagccacccctgcccgccggcctccgagtccccgaaggtcccaccatccccgcaggaactccctggatggagggggccgatcccggggagcgggttctgcacagcctgaaccccagcacttccagcccaaaaagcacaactcttatccccagccaccccaaccctacccagcccagcggcccccagggccccgctaccccccatacactactcccccacgaatgagacggcagcgttctgcccctgacctcaaggagagtggggcagctgtgtgagtcccacatcctgggcagagggcctggtggggccccttgctaggagaagggaagacgcccgagacgctgcttccccagaagtgctggggcagggaggcccaggagatgagagagaaggtccgagtaggtgatagaagacaagggggagaccgagccggaggctgaggaaaggaagagggcacggagttgccaggagcaaaccaaagtgaagagagagataggaagctgcctcggggccaccccttgcaaagggggtgtgtcccacaaacgctgctatgggtggggtggggggctggggtgctgcgtagccagtgtttgactttcttttcaagtgggggaaagtgggagaggactgagagtgaggcaagttctccccagcccctgtccgtctgtctgtctgtctgtggtggtttctgtttcttgggaggcatggtaggatcataagtcattcccctccccttccaggcctcctgctatatttgggggacctgactggtttggctggagtcccatgaggatgtgggccctttaataaaggatagcaaacagggagcttgtggcctgtttgttttgggttttcatggaggtgtaggttatataaggcaatggcacaggtcttaagcatacttatcagtgaagtattgtatgtgtgctctgtgcaggcaccacccagatctggatataagaatgtttccatcttgtcttcctgaacttcaccctcctgtctcttccttcagggtgcgcagcccgatcttttccccgctttttttttttgggagacagggtcttgctttgttgcccaggctggaggtacagtcttggctcactgcagcctccgcctcctgagtagctgggattacaggcatgtgccaccacgcccggctcattactgttttttttgtagtgacgaggtttcaccagcctgggcaacatggtgaaaccctgtatctacaaaacatagaaaaactagttgggtgtggtggtgtgtacctgtagttccagctactagggaggtaggaagatcacctgagcccatggagattgaggctgtggtgagctgtgaaggcaccacagcactctggcctgggcaagagtgggactctctca

SEQ ID NO: 369115 - DNA, 4171 bp, Homo sapiens
cgctcccgccccagctcgcgctgcccgggcgggcgccggccgctggcgccgctactgctgccgcccccggggcgcgagtccgccgcccgccgcccgggcacccggcgaggggcgggggcagctccgaaccggccccagatccttcccgcttccgcctcacgcttcccggaaagcttgtccctctccgccgagctgctccgggagccccgccgcgccgagggtatctcccagagccccagctggtgtggccaggccccaggagtaggatggggctccccctacgagggccggtggcagccagaactgatacagcccccctggtctggggccaggacgccagctgaggagggcaggagtgtctggagctatggctggtgcctcggtgaaagtggcagtgagggttcggccctttaacgcccgtgagaccagccaggatgccaagtgtgtggtcagcatgcagggcaacaccacctccatcatcaatcctaaacagagcaaggatgcccccaaaagcttcacctttgactactcctactggtcacacacttcgacggaggacccccagtttgcatctcagcagcaagtgtatcgggacattggagaagagatgctgctccacgcctttgaaggctacaacgtgtgcatctttgcctatgggcagaccggggctgggaaatcctataccatgatggggcgacaggagccagggcagcagggcatcgtgccccagctctgtgaggacctcttctctcgcgttagtgagaaccagagtgctcagctatcctactctgtggaggtgagctatatggagatctactgtgagcgggtacgagacctcttgaaccccaagagtcggggttctctgcgggtccgggagcaccccatcctgggcccgtacgtgcaggacctgtccaaattggctgtgacctcctacgcagacattgctgacctcatggactgtggaaataaagcacggactgtggctgccaccaacatgaatgagaccagcagccgttcccatgccgtctttaccatcgtcttcacacagcgctgccatgaccagctcacggggctggactcggagaaggtcagtaagatcagtttggtggaccttgctgggagtgagcgagccgactcctcaggggcccggggcatgcgcctgaaggaaggagccaacatcaataagtccctgactacactagggaaagtgatctcggcccttgcagatatgcaatcaaagaagcgaaagtcggattttatcccctacagggactctgtgctcacctggctgctcaaggaaaatttgggggggaactcacgcacagccatgattgcagccctgagccctgctgacatcaattacgaggagactctcagcaccctcaggtatgctgaccgcaccaagcaaatccgctgcaatgccatcatcaacgaggaccctaatgcccggctgattagagagctgcaggaggaagtagcccggctgcgggaactgctgatggctcagggactgtcagcctctgctctggaaggcctgaagacggaagaagggagtgtcagaggcgccctgccagctgtgtcatctcccccagctccagtttcaccctcatcacccaccacacataatggggagctggagccgtcattctcccccaacacggagtcccagattgggcctgaggaagccatggagaggctgcaggagacagagaagattatagctgagctgaacgagacatgggaggagaagctacgcaagacagaagccctgaggatggagagagaagcattgctggctgagatgggggtggccgtccgggaggatgggggaactgtgggcgtcttctctccaaagaagactccccacctggtgaacctgaacgaagaccctctgatgtctgagtgtctgctctaccacatcaaagatggcgtcaccagggtcggccaagtagatatggacatcaagctgaccggacagttcattcgggagcaacactgtctgttccggagcatcccccagccagatggagaagtggtggtcactctggagccttgtgaaggagctgagacatatgtgaatgggaagcttgtgacggagccgctggtgctgaagtcagggaataggattgtgatgggcaagaaccacgttttccgcttcaaccacccggagcaggcaaggctggaacgggaacgaggggtccccccacccccaggaccgccctctgagccagtcgactggaactttgcccagaaggaactgctggagcagcaaggcatcgacataaagctggaaatggagaagaggctgcaggatctggagaatcagtaccggaaagaaaaggaagaagccgatcttctgctggagcagcagcgactgtatgcagactcggacagcggggatgactctgacaagcgctcttgtgaagagagctggaggctcatctcctccttgcgggagcagctgccgcccaccacggtccagaccattgtcaaacgctgtggtctgcccagcagtggcaagcgcagggcccctcgcagggtttatcagatcccccagcgacgcaggctgcagggcaaagacccccgctgggccaccatggctgacctgaagatgcaggcggtgaaggagatctgctacgaggtggccctggctgacttccgccacgggcgggctgagattgaggccctggccgccctcaagatgcgggagctgtgtcgcacctatggcaagccagacggccccggagacgcctggagggctgtggcccgggatgtctgggacactgtaggcgaggaggaaggaggtggagctggcagtggtggtggcagtgaggagggagcccgaggggcggaggtggaggacctccgggcccacatcgacaagctgacggggattctgcaggaggtgaagctgcagaacagcagcaaggaccgggagctgcaggccctgcgggaccgcatgctccgcatggagagggtcatccccctggcccaggatcatgaggatgagaatgaagaaggtggtgaggtcccctgggccccgcctgaaggatcagaggcagcagaggaggcagcccccagtgaccgcatgccgtcagcccggcccccctcgccgccactgtcaagctgggagcgggtgtcacggctcatggaggaggaccctgccttccgtcgtggtcgtcttcgctggctcaagcaggagcagctacggctgcagggactgcagggctctgggggccggggcggggggctgcgcaggcccccagcccgctttgtgccccctcacgactgcaagctacgcttccccttcaagagcaacccccagcaccgggagtcttggccagggatggggagcggggaggctccaactccgctccaaccccctgaggaggtcactccccatccagccacccctgcccgccggcctccgagtccccgaaggtcccaccatccccgcaggaactccctggatggagggggccgatcccggggagcgggttctgcacagcctgaaccccagcacttccagcccaaaaagcacaactcttatccccagccaccccaaccctacccagcccagcggcccccagggccccgctaccccccatacactactcccccacgaatgagacggcagcgttctgcccctgacctcaaggagagtggggcagctgtgtgagtcccacatcctgggcagagggcctggtggggccccttgctaggagaagggaagacgcccgagacgctgcttccccagaagtgctggggcagggaggcccaggagatgagagagaaggtccgagtaggtgatagaagacaagggggagaccgagccggaggctgaggaaaggaagagggcacggagttgccagacctccgggcccacatcgtcaagctgacggggattctgcaggaggtcaagcgtagccagtgtttgactttcttttcaagtgggggaaagtgggagaggactgagagtgaggcaagttctccccagcccctgtccgtctgtctgtctgtctgtggtggtttctgtttcttgggaggcatggtaggatcataagtcattcccctccccttccaggcctcctgctatatttgggggacctgactggtttggctggagtcccatgaggatgtgggccctttaataaaggatagcaaacaggga

SEQ ID NO: 369116 - DNA, 3995 bp, Homo sapiens
cgctcccgccccagctcgcgctgcccgggcgggcgccggccgctggcgccgctactgctgccgcccccggggcgcgagtccgccgcccgccgcccgggcacccggcgaggggcgggggcagctccgaaccggccccagatccttcccgcttccgcctcacgcttcccggaaagcttgtccctctccgccgagctgctccgggagccccgccgcgccgagggtatctcccagagccccagctggtgtggccaggccccaggagtaggatggggctccccctacgagggccggtggcagccagaactgatacagcccccctggtctggggccaggacgccagctgaggagggcaggagtgtctggagctatggctggtgcctcggtgaaagtggcagtgagggttcggccctttaacgcccgtgagaccagccaggatgccaagtgtgtggtcagcatgcagggcaacaccacctccatcatcaatcctaaacagagcaaggatgcccccaaaagcttcacctttgactactcctactggtcacacacttcgacggaggacccccagtttgcatctcagcagcaagtgtatcgggacattggagaagagatgctgctccacgcctttgaaggctacaacgtgtgcatctttgcctatgggcagaccggggctgggaaatcctataccatgatggggcgacaggagccagggcagcagggcatcgtgccccagctctgtgaggacctcttctctcgcgttagtgagaaccagagtgctcagctatcctactctgtggaggtgagctatatggagatctactgtgagcgggtacgagacctcttgaaccccaagagtcggggttctctgcgggtccgggagcaccccatcctgggcccgtacgtgcaggacctgtccaaattggctgtgacctcctacgcagacattgctgacctcatggactgtggaaataaagcacggactgtggctgccaccaacatgaatgagaccagcagccgttcccatgccgtctttaccatcgtcttcacacagcgctgccatgaccagctcacggggctggactcggagaaggtcagtaagatcagtttggtggaccttgctgggagtgagcgagccgactcctcaggggcccggggcatgcgcctgaaggaaggagccaacatcaataagtccctgactacactagggaaagtgatctcggcccttgcagatatgcaatcaaagaagcgaaagtcggattttatcccctacagggactctgtgctcacctggctgctcaaggaaaatttgggggggaactcacgcacagccatgattgcagccctgagccctgctgacatcaattacgaggagactctcagcaccctcaggtatgctgaccgcaccaagcaaatccgctgcaatgccatcatcaacgaggaccctaatgcccggctgattagagagctgcaggaggaagtagcccggctgcgggaactgctgatggctcagggactgtcagcctctgctctggaaggcctgaagacggaagaagggagtgtcagaggcgccctgccagctgtgtcatctcccccagctccagtttcaccctcatcacccaccacacataatggggagctggagccgtcattctcccccaacacggagtcccagattgggcctgaggaagccatggagaggctgcaggagacagagaagattatagctgagctgaacgagacatgggaggagaagctacgcaagacagaagccctgaggatggagagagaagcattgctggctgagatgggggtggccgtccgggaggatgggggaactgtgggcgtcttctctccaaagaagactccccacctggtgaacctgaacgaagaccctctgatgtctgagtgtctgctctaccacatcaaagatggcgtcaccagggtcggccaagtagatatggacatcaagctgaccggacagttcattcgggagcaacactgtctgttccggagcatcccccagccagatggagaagtggtggtcactctggagccttgtgaaggagctgagacatatgtgaatgggaagcttgtgacggagccgctggtgctgaagtcagggaataggattgtgatgggcaagaaccacgttttccgcttcaaccacccggagcaggcaaggctggaacgggaacgaggggtccccccacccccaggaccgccctctgagccagtcgactggaactttgcccagaaggaactgctggagcagcaaggcatcgacataaagctggaaatggagaagaggctgcaggatctggagaatcagtaccggaaagaaaaggaagaagccgatcttctgctggagcagcagcgactgtatgcagactcggacagcggggatgactctgacaagcgctcttgtgaagagagctggaggctcatctcctccttgcgggagcagctgccgcccaccacggtccagaccattgtcaaacgctgtggtctgcccagcagtggcaagcgcagggcccctcgcagggtttatcagatcccccagcgacgcaggctgcagggcaaagacccccgctgggccaccatggctgacctgaagatgcaggcggtgaaggagatctgctacgaggtggccctggctgacttccgccacgggcgggctgagattgaggccctggccgccctcaagatgcgggagctgtgtcgcacctatggcaagccagacggccccggagacgcctggagggctgtggcccgggatgtctgggacactgtaggcgaggaggaaggaggtggagctggcagtggtggtggcagtgaggagggagcccgaggggcggaggtggaggacctccgggcccacatcgacaagctgacggggattctgcaggaggtgaagctgcagaacagcagcaaggaccgggagctgcaggccctgcgggaccgcatgctccgcatggagagggtcatccccctggcccaggatcatgaggatgagaatgaagaaggtggtgaggtcccctgggccccgcctgaaggatcagaggcagcagaggaggcagcccccagtgaccgcatgccgtcagcccggcccccctcgccgccactgtcaagctgggagcgggtgtcacggctcatggaggaggaccctgccttccgtcgtggtcgtcttcgctggctcaagcaggagcagctacggctgcagggactgcagggctctgggggccggggcggggggctgcgcaggcccccagcccgctttgtgccccctcacgactgcaagctacgcttccccttcaagagcaacccccagcaccgggagtcttggccagggatggggagcggggaggctccaactccgctccaaccccctgaggaggtcactccccatccagccacccctgcccgccggcctccgagtccccgaaggtcccaccatccccgcaggaactccctggatggagggggccgatcccggggagcgggttctgcacagcctgaaccccagcacttccagcccaaaaagcacaactcttatccccagccaccccaaccctacccagcccagcggcccccagggccccgctaccccccatacactactcccccacgaatgagacggcagcgttctgcccctgacctcaaggagagtggggcagctgtgtgagtcccacatcctgggcagagggcctggtggggccccttgctaggagaagggaagacgcccgagacgctgcttccccagaagtgctggggcagggaggcccaggagatgagagagaaggtccgagtaggcaagttctccccagcccctgtccgtctgtctgtctgtctgtggtggtttctgtttcttgggaggcatggtaggatcataagtcattcccctccccttccaggcctcctgctatatttgggggacctgactggtttggctggagtcccatgaggatgtgggccctttaataaaggatagcaaacaggga

SEQ ID NO: 369117 - DNA, 3706 bp, Homo sapiens
cgctcccgccccagctcgcgctgcccgggcgggcgccggccgctggcgccgctactgctgccgcccccggggcgcgagtccgccgcccgccgcccgggcacccggcgaggggcgggggcagctccgaaccggccccagatccttcccgcttccgcctcacgcttcccggaaagcttgtccctctccgccgagctgctccgggagccccgccgcgccgagggtatctcccagagccccagctggtgtggccaggccccaggagtaggatggggctccccctacgagggccggtggcagccagaactgatacagcccccctggtctggggccaggacgccagctgaggagggcaggagtgtctggagctatggctggtgcctcggtgaaagtggcagtgagggttcggccctttaacgcccgtgagaccagccaggatgccaagtgtgtggtcagcatgcagggcaacaccacctccatcatcaatcctaaacagagcaaggatgcccccaaaagcttcacctttgactactcctactggtcacacacttcgacggaggacccccagtttgcatctcagcagcaagtgtatcgggacattggagaagagatgctgctccacgcctttgaaggctacaacgtgtgcatctttgcctatgggcagaccggggctgggaaatcctataccatgatggggcgacaggagccagggcagcagggcatcgtgccccagctctgtgaggacctcttctctcgcgttagtgagaaccagagtgctcagctatcctactctgtggaggtgagctatatggagatctactgtgagcgggtacgagacctcttgaaccccaagagtcggggttctctgcgggtccgggagcaccccatcctgggcccgtacgtgcaggacctgtccaaattggctgtgacctcctacgcagacattgctgacctcatggactgtggaaataaagcacggactgtggctgccaccaacatgaatgagaccagcagccgttcccatgccgtctttaccatcgtcttcacacagcgctgccatgaccagctcacggggctggactcggagaaggtcagtaagatcagtttggtggaccttgctgggagtgagcgagccgactcctcaggggcccggggcatgcgcctgaaggaaggagccaacatcaataagtccctgactacactagggaaagtgatctcggcccttgcagatatgcaatcaaagaagcgaaagtcggattttatcccctacagggactctgtgctcacctggctgctcaaggaaaatttgggggggaactcacgcacagccatgattgcagccctgagccctgctgacatcaattacgaggagactctcagcaccctcaggtatgctgaccgcaccaagcaaatccgctgcaatgccatcatcaacgaggaccctaatgcccggctgattagagagctgcaggaggaagtagcccggctgcgggaactgctgatggctcagggactgtcagcctctgctctggaaggcctgaagacggaagaagggagtgtcagaggcgccctgccagctgtgtcatctcccccagctccagtttcaccctcatcacccaccacacataatggggagctggagccgtcattctcccccaacacggagtcccagattgggcctgaggaagccatggagaggctgcagccagtcgactggaactttgcccagaaggaactgctggagcagcaaggcatcgacataaagctggaaatggagaagaggctgcaggatctggagaatcagtaccggaaagaaaaggaagaagccgatcttctgctggagcagcagcgactgtatgcagactcggacagcggggatgactctgacaagcgctcttgtgaagagagctggaggctcatctcctccttgcgggagcagctgccgcccaccacggtccagaccattgtcaaacgctgtggtctgcccagcagtggcaagcgcagggcccctcgcagggtttatcagatcccccagcgacgcaggctgcagggcaaagacccccgctgggccaccatggctgacctgaagatgcaggcggtgaaggagatctgctacgaggtggccctggctgacttccgccacgggcgggctgagattgaggccctggccgccctcaagatgcgggagctgtgtcgcacctatggcaagccagacggccccggagacgcctggagggctgtggcccgggatgtctgggacactgtaggcgaggaggaaggaggtggagctggcagtggtggtggcagtgaggagggagcccgaggggcggaggtggaggacctccgggcccacatcgacaagctgacggggattctgcaggaggtgaagctgcagaacagcagcaaggaccgggagctgcaggccctgcgggaccgcatgctccgcatggagagggtcatccccctggcccaggatcatgaggatgagaatgaagaaggtggtgaggtcccctgggccccgcctgaaggatcagaggcagcagaggaggcagcccccagtgaccgcatgccgtcagcccggcccccctcgccgccactgtcaagctgggagcgggtgtcacggctcatggaggaggaccctgccttccgtcgtggtcgtcttcgctggctcaagcaggagcagctacggctgcagggactgcagggctctgggggccggggcggggggctgcgcaggcccccagcccgctttgtgccccctcacgactgcaagctacgcttccccttcaagagcaacccccagcaccgggagtcttggccagggatggggagcggggaggctccaactccgctccaaccccctgaggaggtcactccccatccagccacccctgcccgccggcctccgagtccccgaaggtcccaccatccccgcaggaactccctggatggagggggccgatcccggggagcgggttctgcacagcctgaaccccagcacttccagcccaaaaagcacaactcttatccccagccaccccaaccctacccagcccagcggcccccagggccccgctaccccccatacactactcccccacgaatgagacggcagcgttctgcccctgacctcaaggagagtggggcagctgtgtgagtcccacatcctgggcagagggcctggtggggccccttgctaggagaagggaagacgcccgagacgctgcttccccagaagtgctggggcagggaggcccaggagatgagagagaaggtccgagtaggtgatagaagacaagggggagaccgagccggaggctgaggaaaggaagagggcacggagttgccaggagcaaaccaaagtgaagagagagataggaagctgcctcggggccaccccttgcaaagggggtgtgtcccacaaacgctgctatgggtggggtggggggctggggtgctgcgtagccagtgtttgactttcttttcaagtgggggaaagtgggagaggactgagagtgaggcaagttctccccagcccctgtccgtctgtctgtctgtctgtggtggtttctgtttcttgggaggcatggtaggatcataagtcattcccctccccttccaggcctcctgctatatttgggggacctgactggtttggctggagtcccatgaggatgtgggccctttaataaaggatagcaaacaggga

SEQ ID NO: 369118 - DNA, 2587 bp, Homo sapiens
ctctctccacactggatatgaagaggcagctgcctatattcaatgccagtttgaagatctgaacagaagaaaagataccaaggagatctatactcacttcacctgtgccacagacacgaagaatgtgcagtttgtttttgatgctgttacagatgtcatcattaaaaacaacttaaaggaatgtggactttattgagaagcatggatgttagtgaaagttactacagtgcggagtgttgagaccagacaccttttgctgtctcatggggcagctacaagcatgaacgggaccagggtcggccaagtagatatggacatcaagctgaccggacagttcattcgggagcaacactgtctgttccggagcatcccccagccagatggagaagtggtggtcactctggagccttgtgaaggagctgagacatatgtgaatgggaagcttgtgacggagccgctggtgctgaagtcagggaataggattgtgatgggcaagaaccacgttttccgcttcaaccacccggagcaggcaaggctggaacgggaacgaggggtccccccacccccaggaccgccctctgagccagtcgactggaactttgcccagaaggaactgctggagcagcaaggcatcgacataaagctggaaatggagaagaggctgcaggatctggagaatcagtaccggaaagaaaaggaagaagccgatcttctgctggagcagcagcgactgtatgcagactcggacagcggggatgactctgacaagcgctcttgtgaagagagctggaggctcatctcctccttgcgggagcagctgccgcccaccacggtccagaccattgtcaaacgctgtggtctgcccagcagtggcaagcgcagggcccctcgcagggtttatcagatcccccagcgacgcaggctgcagggcaaagacccccgctgggccaccatggctgacctgaagatgcaggcggtgaaggagatctgctacgaggtggccctggctgacttccgccacgggcgggctgagattgaggccctggccgccctcaagatgcgggagctgtgtcgcacctatggcaagccagacggccccggagacgcctggagggctgtggcccgggatgtctgggacactgtaggcgaggaggaaggaggtggagctggcagtggtggtggcagtgaggagggagcccgaggggcggaggtggaggacctccgggcccacatcgacaagctgacggggattctgcaggaggtgaagctgcagaacagcagcaaggaccgggagctgcaggccctgcgggaccgcatgctccgcatggagagggtcatccccctggcccaggatcatgaggatgagaatgaagaaggtggtgaggtcccctgggccccgcctgaaggatcagaggcagcagaggaggcagcccccagtgaccgcatgccgtcagcccggcccccctcgccgccactgtcaagctgggagcgggtgtcacggctcatggaggaggaccctgccttccgtcgtggtcgtcttcgctggctcaagcaggagcagctacggctgcagggactgcagggctctgggggccggggcggggggctgcgcaggcccccagcccgctttgtgccccctcacgactgcaagctacgcttccccttcaagagcaacccccagcaccgggagtcttggccagggatggggagcggggaggctccaactccgctccaaccccctgaggaggtcactccccatccagccacccctgcccgccggcctccgagtccccgaaggtcccaccatccccgcaggaactccctggatggagggggccgatcccggggagcgggttctgcacagcctgaaccccagcacttccagcccaaaaagcacaactcttatccccagccaccccaaccctacccagcccagcggcccccagggccccgctaccccccatacactactcccccacgaatgagacggcagcgttctgcccctgacctcaaggagagtggggcagctgtgtgagtcccacatcctgggcagagggcctggtggggccccttgctaggagaagggaagacgcccgagacgctgcttccccagaagtgctggggcagggaggcccaggagatgagagagaaggtccgagtaggtgatagaagacaagggggagaccgagccggaggctgaggaaaggaagagggcacggagttgccaggagcaaaccaaagtgaagagagagataggaagctgcctcggggccaccccttgcaaagggggtgtgtcccacaaacgctgctatgggtggggtggggggctggggtgctgcgtagccagtgtttgactttcttttcaagtgggggaaagtgggagaggactgagagtgaggcaagttctccccagcccctgtccgtctgtctgtctgtctgtggtggtttctgtttcttgggaggcatggtaggatcataagtcattcccctccccttccaggcctcctgctatatttgggggacctgactggtttggctggagtcccatgaggatgtgggccctttaataaaggatagcaaacaggga

SEQ ID NO: 369119 - DNA, 2314 bp, Homo sapiens
cgttggccattgcttccccagggtcggccaagtagatatggacatcaagctgaccggacagttcattcgggagcaacactgtctgttccggagcatcccccagccagatggagaagtggtggtcactctggagccttgtgaaggagctgagacatatgtgaatgggaagcttgtgacggagccgctggtgctgaagtcagggaataggattgtgatgggcaagaaccacgttttccgcttcaaccacccggagcaggcaaggctggaacgggaacgaggggtccccccacccccaggaccgccctctgagccagtcgactggaactttgcccagaaggaactgctggagcagcaaggcatcgacataaagctggaaatggagaagaggctgcaggatctggagaatcagtaccggaaagaaaaggaagaagccgatcttctgctggagcagcagcgactgtatgcagactcggacagcggggatgactctgacaagcgctcttgtgaagagagctggaggctcatctcctccttgcgggagcagctgccgcccaccacggtccagaccattgtcaaacgctgtggtctgcccagcagtggcaagcgcagggcccctcgcagggtttatcagatcccccagcgacgcaggctgcagggcaaagacccccgctgggccaccatggctgacctgaagatgcaggcggtgaaggagatctgctacgaggtggccctggctgacttccgccacgggcgggctgagattgaggccctggccgccctcaagatgcgggagctgtgtcgcacctatggcaagccagacggccccggagacgcctggagggctgtggcccgggatgtctgggacactgtaggcgaggaggaaggaggtggagctggcagtggtggtggcagtgaggagggagcccgaggggcggaggtggaggacctccgggcccacatcgacaagctgacggggattctgcaggaggtgaagctgcagaacagcagcaaggaccgggagctgcaggccctgcgggaccgcatgctccgcatggagagggtcatccccctggcccaggatcatgaggatgagaatgaagaaggtggtgaggtcccctgggccccgcctgaaggatcagaggcagcagaggaggcagcccccagtgaccgcatgccgtcagcccggcccccctcgccgccactgtcaagctgggagcgggtgtcacggctcatggaggaggaccctgccttccgtcgtggtcgtcttcgctggctcaagcaggagcagctacggctgcagggactgcagggctctgggggccggggcggggggctgcgcaggcccccagcccgctttgtgccccctcacgactgcaagctacgcttccccttcaagagcaacccccagcaccgggagtcttggccagggatggggagcggggaggctccaactccgctccaaccccctgaggaggtcactccccatccagccacccctgcccgccggcctccgagtccccgaaggtcccaccatccccgcaggaactccctggatggagggggccgatcccggggagcgggttctgcacagcctgaaccccagcacttccagcccaaaaagcacaactcttatccccagccaccccaaccctacccagcccagcggcccccagggccccgctaccccccatacactactcccccacgaatgagacggcagcgttctgcccctgacctcaaggagagtggggcagctgtgtgagtcccacatcctgggcagagggcctggtggggccccttgctaggagaagggaagacgcccgagacgctgcttccccagaagtgctggggcagggaggcccaggagatgagagagaaggtccgagtaggtgatagaagacaagggggagaccgagccggaggctgaggaaaggaagagggcacggagttgccaggagcaaaccaaagtgaagagagagataggaagctgcctcggggccaccccttgcaaagggggtgtgtcccacaaacgctgctatgggtggggtggggggctggggtgctgcgtagccagtgtttgactttcttttcaagtgggggaaagtgggagaggactgagagtgaggcaagttctccccagcccctgtccgtctgtctgtctgtctgtggtggtttctgtttcttgggaggcatggtaggatcataagtcattcccctccccttccaggcctcctgctatatttgggggacctgactggtttggctggagtcccatgaggatgtgggccctttaataaaggatagcaaacaggga

SEQ ID NO: 369120 - DNA, 2514 bp, Homo sapiens
cgctcccgccccagctcgcgctgcccgggcgggcgccggccgctggcgccgctactgctgccgcccccggggcgcgagtccgccgcccgccgcccgggcacccggcgaggggcgggggcagctccgaaccggccccagatccttcccgcttccgcctcacgcttcccggaaagcttgtccctctccgccgagctgctccgggagccccgccgcgccgagggtatctcccagagccccagctggtgtggccaggccccaggagtaggatggggctccccctacgagggccggtggcagccagaactgatacagcccccctggtctggggccaggacgccagctgaggagggcaggagtgtctggagctatggctggtgcctcggtgaaagtggcagtgagggttcggccctttaacgcccgtgagaccagccaggatgccaagtgtgtggtcagcatgcagggcaacaccacctccatcatcaatcctaaacagagcaaggatgcccccaaaagcttcacctttgactactcctactggtcacacacttcgacggaggacccccagtttgcatctcagcagcaagtgtatcgggacattggagaagagatgctgctccacgcctttgaaggctacaacgtgtgcatctttgcctatgggcagaccggggctgggaaatcctataccatgatggggcgacaggagccagggcagcagggcatcgtgccccagctctgtgaggacctcttctctcgcgttagtgagaaccagagtgctcagctatcctactctgtggaggtgagctatatggagatctactgtgagcgggtacgagacctcttgaaccccaagagtcggggttctctgcgggtccgggagcaccccatcctgggcccgtacgtgcaggacctgtccaaattggctgtgacctcctacgcagacattgctgacctcatggactgtggaaataaagcacggactgtggctgccaccaacatgaatgagaccagcagccgttcccatgccgtctttaccatcgtcttcacacagcgctgccatgaccagctcacggggctggactcggagaaggtcagtaagatcagtttggtggaccttgctgggagtgagcgagccgactcctcaggggcccggggcatgcgcctgaaggaaggagccaacatcaataagtccctgactacactagggaaagtgatctcggcccttgcagatatgcaatcaaagaagcgaaagtcggattttatcccctacagggactctgtgctcacctggctgctcaaggaaaatttgggggggaactcacgcacagccatgattgcagccctgagccctgctgacatcaattacgaggagactctcagcaccctcaggtatgctgaccgcaccaagcaaatccgctgcaatgccatcatcaacgaggaccctaatgcccggctgattagagagctgcaggaggaagtagcccggctgcgggaactgctgatggctcagggactgtcagcctctgctctggaaggcctgaagacggaagaagggagtgtcagaggcgccctgccagctgtgtcatctcccccagctccagtttcaccctcatcacccaccacacataatggggagctggagccgtcattctcccccaacacggagtcccagattgggcctgaggaagccatggagaggctgcaggagacagagaagattatagctgagctgaacgagacatgggaggagaagctacgcaagacagaagccctgaggatggagagagaagcattgctggctgagatgggggtggccgtccgggaggatgggggaactgtgggcgtcttctctccaaagaagactccccacctggtgaacctgaacgaagaccctctgatgtctgagtgtctgctctaccacatcaaagatggcgtcaccagggtcggccaagtagatatggacatcaagctgaccggacagttcattcgggagcaacactgtctgttccggagcatcccccagccagatggagaagtggtggtcactctggagccttgtgaaggagctgagacatatgtgaatgggaagcttgtgacggagccgctggtgctgaagtcagggaataggattgtgatgggcaagaaccacgttttccgcttcaaccacccggagcaggcaaggctggaacgggaacgaggggtccccccacccccaggaccgccctctgagccagtcgactggaactttgcccagaaggaactgctggagcagcaaggcatcgacataaagctggaaatggagaagaggctgcaggatctggagaatcagtaccggaaataaaatacagaactttccagaagcagcaggagctggacatggtgctcatgtctatcacctcagcaactctggaggagtcacctgagcccaggtgttttttctttttgtttgtttttgagatgggtctgctctattgcccagactggaggcaggtgggtacggggtcctctaagtcacct

SEQ ID NO: 369121 - DNA, 1980 bp, Homo sapiens
cgctcccgccccagctcgcgctgcccgggcgggcgccggccgctggcgccgctactgctgccgcccccggggcgcgagtccgccgcccgccgcccgggcacccggcgaggggcgggggcagctccgaaccggccccagatccttcccgcttccgcctcacgcttcccggaaagcttgtccctctccgccgagctgctccgggagccccgccgcgccgagggtatctcccagagccccagctggtgtggccaggccccaggagtaggatggggctccccctacgagggccggtggcagccagaactgatacagcccccctggtctggggccaggacgccagctgaggagggcaggagtgtctggagctatggctggtgcctcggtgaaagtggcagtgagggttcggccctttaacgcccgtgagaccagccaggatgccaagtgtgtggtcagcatgcagggcaacaccacctccatcatcaatcctaaacagagcaaggatgcccccaaaagcttcacctttgactactcctactggtcacacacttcgacggaggacccccagtttgcatctcagcagcaagtgtatcgggacattggagaagagatgctgctccacgcctttgaaggctacaacgtgtgcatctttgcctatgggcagaccggggctgggaaatcctataccatgatggggcgacaggagccagggcagcagggcatcgtgccccagctctgtgaggacctcttctctcgcgttagtgagaaccagagtgctcagctatcctactctgtggaggtgagctatatggagatctactgtgagcgggtacgagacctcttgaaccccaagagtcggggttctctgcgggtccgggagcaccccatcctgggcccgtacgtgcaggacctgtccaaattggctgtgacctcctacgcagacattgctgacctcatggactgtggaaataaagcacggactgtggctgccaccaacatgaatgagaccagcagccgttcccatgccgtctttaccatcgtcttcacacagcgctgccatgaccagctcacggggctggactcggagaaggtcagtaagatcagtttggtggaccttgctgggagtgagcgagccgactcctcaggggcccggggcatgcgcctgaaggaaggagccaacatcaataagtccctgactacactagggaaagtgatctcggcccttgcagatatgcaatcaaagaagcgaaagtcggattttatcccctacagggactctgtgctcacctggctgctcaaggaaaatttgggagacagagaagattatagctgagctgaacgagacatgggaggagaagctacgcaagacagaagccctgaggatggagagagaagcattgctggctgagatgggggtggccgtccgggaggatgggggaactgtgggcgtcttctctccaaagaaggtgagtgaggaatcgagcgaggaggcctagagagctctctggatgcctagaaaagaggcagcaggtgcagggtagtgagtgctgtccctgatcgctccctttgaggtccccggcttgtccctccatcatttctgtcccctcccctgccacctcctctccgtcttgtttagtcatccctgccttctcccttcagccattcaacagtcagcctcaggagagggagaggacctgggaaatcggaggttggttgcaatagagcatgcttttgtatcatttgagttttgtattctgtgcatgctcaaaaagataactaaagaaatctatttttcagaaggataacttgggaagacaagactaaagggaatagaggaggcatgagcactacattgtaagacagtggttgccagtgcagcgaggggttggttatagatggaggcacccgtgtagcttggagctatgctgcaactggtttcctggaggaggtggtttggaaagtggaacctgaaagatggacagg

SEQ ID NO: 369122 - DNA, 942 bp, Homo sapiens
ggaattatcggttcgaacccaacggccgtttccggccccacgcgtcgcgtctgtctgtctctgtctgtggtggtttctgtttcttgggaggcatggtaggatcataagtcattcccctccccttccaggcctcctgctatatttgggggacctgactggtttggctggagtcccatgaggatgaggactgagagtgaggcaagttctccccagcccctgtccgtctgtctgtctgtctgtggtggtttctgtttcttgggaggcatggtaggatcataagtcattcccctccccttccaggcctcctgctatatttgggggacctgactggtttggctggagtcccatgaggatgtgggccctttaataaaggatagcaaacagggagcttgtggcctgtttgttttgggttttcatggaggtgtaggttatataaggcaatggcacaggtcttaagcatacttatcagtgaagtattgtatgtgtgctctgtgcaggcaccacccagatctggatataagaatgtttccatcttgtcttcctgaacttcaccctcctgtctcttccttcagggtgcgcagcccgatcttttccccgctttttttttttgggagacagggtcttgctttgttgcccaggctggaggtacagtcttggctcactgcagcctccgcctcctgagtagctgggattacaggcatgtgccaccacgcccggctcattactgttttttttgtagtgacgaggtttcaccagcctgggcaacatggtgaaaccctgtatctacaaaacatagaaaaactagttgggtgtggtggtgtgtacctgtagttccagctactagggaggtaggaagatcacctgagcccatggagattgaggctgtggtgagctgtgaaggcaccacagcactctggcctgggcaagagtgggactctctca

SEQ ID NO: 369123 - DNA, 867 bp, Homo sapiens
cgctcccgccccagctcgcgctgcccgggcgggcgccggccgctggcgccgctactgctgccgcccccggggcgcgagtccgccgcccgccgcccgggcacccggcgaggggcgggggcagctccgaaccggccccagatccttcccgcttccgcctcacgcttcccggaaagcttgtccctctccgccgagctgctccgggagccccgccgcgccgagggtatctcccagagccccagctggtgtggccaggccccaggagtaggatggggctccccctacgagggccggtggcagccagaactgatacagcccccctggtctggggccaggacgccagctgaggagggcaggagtgtctggagctatggctggtgcctcggtgaaagtggcagtgagggttcggccctttaacgcccgtgagaccagccaggatgccaagtgtgtggtcagcatgcagggcaacaccacctccatcatcaatcctaaacagagcaaggatgcccccaaaagcttcacctttgactactcctactggtcacacacttcgacggaggacccccagtttgcatctcagcagcaagtgtatcgggacattggagaagagatgctgctccacgcctttgaaggctacaacgtgtgcatctttgcctatgggcagaccggggctgggaaatcctataccatgatggggcgacaggagccagggcagcagggcatcgtgccccagctctgtgaggacctcttctctcgcgttagtgagaaccagagtgctcagctatcctactctgtggagtgctgacctgcatggacatgtggaaataaagcacggacattgctgccaccaatacaacgaggcagcagcag

SEQ ID NO: 369124 - DNA, 323 bp, Homo sapiens
tgtcccttgtccatgcctgcggtgggcctgtagctatttgtaattgagtgagtaaccaccgtctcactgttgtcacgtattctgtttcccccggcctcctccctctcctcctcctggctctctctagcccttgccagctgcccacattcctgctgggtgcttccctgatttccctgccccgtcccccacccgcaccttatctcctgcctgtttcctctgaccccaggtcagtaagatcagtttggtggaccttgctgggagtgagcgagccgactcctcaggggcccggggcatgcgcctgaaggtgaggggccttcagaggg

SEQ ID NO: 369125 - DNA, 6217 bp, Homo sapiens
  misc_feature (4649)..(4649): n is a, c, g, or t
  misc_feature (4663)..(4663): n is a, c, g, or t
  misc_feature (4676)..(4676): n is a, c, g, or t
  misc_feature (4784)..(4784): n is a, c, g, or t
  misc_feature (5545)..(5545): n is a, c, g, or t
  misc_feature (6134)..(6134): n is a, c, g, or t
cgctcccgccccagctcgcgctgcccgggcgggcgccggccgctggcgccgctactgctgccgcccccggggcgcgagtccgccgcccgccgcccgggcacccggcgaggggcgggggcagctccgaaccggccccagatccttcccgcttccgcctcacgcttcccggaaagcttgtccctctccgccgagctgctccgggagccccgccgcgccgagggtatctcccagagccccagctggtgtggccaggccccaggagtaggatggggctccccctacgagggccggtggcagccagaactgatacagcccccctggtctggggccaggacgccagctgaggagggcaggagtgtctggagctatggctggtgcctcggtgaaagtggcagtgagggttcggccctttaacgcccgtgagaccagccaggatgccaagtgtgtggtcagcatgcagggcaacaccacctccatcatcaatcctaaacagagcaaggatgcccccaaaagcttcacctttgactactcctactggtcacacacttcgacggaggacccccagtttgcatctcagcagcaagtgtatcgggacattggagaagagatgctgctccacgcctttgaaggctacaacgtgtgcatctttgcctatgggcagaccggggctgggaaatcctataccatgatggggcgacaggagccagggcagcagggcatcgtgccccagctctgtgaggacctcttctctcgcgttagtgagaaccagagtgctcagctatcctactctgtggaggtgagctatatggagatctactgtgagcgggtacgagacctcttgaaccccaagagtcggggttctctgcgggtccgggagcaccccatcctgggcccgtacgtgcaggacctgtccaaattggctgtgacctcctacgcagacattgctgacctcatggactgtggaaataaagcacggactgtggctgccaccaacatgaatgagaccagcagccgttcccatgccgtctttaccatcgtcttcacacagcgctgccatgaccagctcacggggctggactcggagaaggtcagtaagatcagtttggtggaccttgctgggagtgagcgagccgactcctcaggggcccggggcatgcgcctgaaggaaggagccaacatcaataagtccctgactacactagggaaagtgatctcggcccttgcagatatgcaatcaaagaagcgaaagtcggattttatcccctacagggactctgtgctcacctggctgctcaaggaaaatttgggggggaactcacgcacagccatgattgcagccctgagccctgctgacatcaattacgaggagactctcagcaccctcaggtatgctgaccgcaccaagcaaatccgctgcaatgccatcatcaacgaggaccctaatgcccggctgattagagagctgcaggaggaagtagcccggctgcgggaactgctgatggctcagggactgtcagcctctgctctggaaggcctgaagacggaagaagggagtgtcagaggcgccctgccagctgtgtcatctcccccagctccagtttcaccctcatcacccaccacacataatggggagctggagccgtcattctcccccaacacggagtcccagattgggcctgaggaagccatggagaggctgcaggagacagagaagattatagctgagctgaacgagacatgggaggagaagctacgcaagacagaagccctgaggatggagagagaagcattgctggctgagatgggggtggccgtccgggaggatgggggaactgtgggcgtcttctctccaaagaagactccccacctggtgaacctgaacgaagaccctctgatgtctgagtgtctgctctaccacatcaaagatggcgtcaccagggtcggccaagtagatatggacatcaagctgaccggacagttcattcgggagcaacactgtctgttccggagcatcccccagccagatggagaagtggtggtcactctggagccttgtgaaggagctgagacatatgtgaatgggaagcttgtgacggagccgctggtgctgaagtcagggaataggattgtgatgggcaagaaccacgttttccgcttcaaccacccggagcaggcaaggctggaacgggaacgaggggtccccccacccccaggaccgccctctgagccagtcgactggaactttgcccagaaggaactgctggagcagcaaggcatcgacataaagctggaaatggagaagaggctgcaggatctggagaatcagtaccggaaagaaaaggaagaagccgatcttctgctggagcagcagcgactgtatgcagactcggacagcggggatgactctgacaagcgctcttgtgaagagagctggaggctcatctcctccttgcgggagcagctgccgcccaccacggtccagaccattgtcaaacgctgtggtctgcccagcagtggcaagcgcagggcccctcgcagggtttatcagatcccccagcgacgcaggctgcagggcaaagacccccgctgggccaccatggctgacctgaagatgcaggcggtgaaggagatctgctacgaggtggccctggctgacttccgccacgggcgggctgagattgaggccctggccgccctcaagatgcgggagctgtgtcgcacctatggcaagccagacggccccggagacgcctggagggctgtggcccgggatgtctgggacactgtaggcgaggaggaaggaggtggagctggcagtggtggtggcagtgaggagggagcccgaggggcggaggtggaggacctccgggcccacatcgacaagctgacggggattctgcaggaggtgaagctgcagaacagcagcaaggaccgggagctgcaggccctgcgggaccgcatgctccgcatggagagggtcatccccctggcccaggatcatgaggatgagaatgaagaaggtggtgaggtcccctgggccccgcctgaaggatcagaggcagcagaggaggcagcccccagtgaccgcatgccgtcagcccggcccccctcgccgccactgtcaagctgggagcgggtgtcacggctcatggaggaggaccctgccttccgtcgtggtcgtcttcgctggctcaagcaggagcagctacggctgcagggactgcagggctctgggggccggggcggggggctgcgcaggcccccagcccgctttgtgccccctcacgactgcaagctacgcttccccttcaagagcaacccccagcaccgggagtcttggccagggatggggagcggggaggctccaactccgctccaaccccctgaggaggtcactccccatccagccacccctgcccgccggcctccgagtccccgaaggtcccaccatccccgcaggaactccctggatggagggggccgatcccggggagcgggttctgcacagcctgaaccccagcacttccagcccaaaaagcacaactcttatccccagccaccccaaccctacccagcccagcggcccccagggccccgctaccccccatacactactcccccacgaatgagacggcagcgttctgcccctgacctcaaggagagtggggcagctgtgtgagtcccacatcctgggcagagggcctggtggggccccttgctaggagaagggaagacgcccgagacgctgcttccccagaagtgctggggcagggaggcccaggagatgagagagaaggtccgagtaggtgatagaagacaagggggagaccgagccggaggctgaggaaaggaagagggcacggagttgccaggagcaaaccaaagtgaagagagagataggaagctgcctcggggccaccccttgcaaagggggtgtgtcccacaaacgctgctatgggtggggtggggggctggggtgctgcgtagccagtgtttgactttcttttcaagtgggggaaagtgggagaggactgagagtgaggcaagttctccccagcccctgtccgtctgtctgtctgtctgtggtggtttctgtttcttgggaggcatggtaggatcataagtcattcccctccccttccaggcctcctgctatatttgggggacctgactggtttggctggagtcccatgaggatgtgggccctttaataaaggatagcaaacagggagcttgtggcctgtttgttttgggttttcatggaggtgtaggttatataaggcaatggcacaggtcttaagcatacttatcagtgaagtattgtatgtgtgctctgtgcaggcaccacccagatctggatataagaatgtttccatcttgtcttcctgaacttcaccctcctgtctcttccttcagggtgcgcagcccgatcttttccccgctttttttttttgggagacagggtcttgctttgttgcccaggctggaggtacagtcttggctcactgcagcctccgcctcctgagtagctgggattacaggcatgtgccaccacgcccggctcattactgttttttttgtagtgacgaggtttcaccgtgttggccaggctggtctcgaactcctgatgacctcaagtgatccgcccnccttggcctcccanagtggtgggattncagagacagtgatcttgctatgctgcccaggctggtctcaaccttatgggctcaagtgatcctcccacctcagcctcccaaagtgctaggattacctgcgtgagctanagcgccctgcctgttctgggcttcttgcagagcctcttcagctgcagagaagcagctctcctttctccaagtccagagccaacaggacgaataatgaagctgttgggaagatttactgataatacatgtaaagggtctagcacattttaggagctcaaggttggtgccttccctttttctttactctgaaccggatatgaggccttgagaaagaagagaggcgcttgcaaaacgaggtgaggtctcaggcacagtggctcacgcctgtaatcccagcactttaggagaccgaggcgggcggatcatgaggtcaggagttcgagaccagcctggccaacatggtgaaagcccgtctctactaaaaatacaaaaattagacgggcatggtggtgggcacctgtaatcccggctacttgggaggttgagggaggagaatcgcttgaacccaggaggtggaggttgcagtgagccgagactgcaccattgcactccagcctgggcaatagagcgagactccgtctcaagcaagcaagcaagcaaacaaacaaaataaaaaacgaggtcaagtttcaaaagatgtcacccccaacctggcaaaacttctcctcaagccctgtcgttccactcttgtccgccaggaggagaaaaggttccctcgaaggacgtctttgcttgcgcgttcacggagccttgagaacgagtggccgaggggacccctgcggccctgcgcgcctaagggaggacctgactcctttcagaantagcatttcttccccttcgtgggtgctcttgagttccaaagaaaaggaagagaagccttcattgagcagcttcttctgccttagggactgtgctagggggtagatcgaccttaggggaaacaatccccgcttattagaggaggttttggatcagggtttgctttatttgaaatttaacaaatacagaaaagcagaaggaagaaaattgaagtaatccatgtttccactgggcgcggcggctcacgcctataatcccagcactttgggaggccaaggcgggcggatcacgaggtcaggagttcgagaccagcctgaccaacatggtgaaaccccccgtctctactaaaattacaaaattagccggtcgtggtggcacacgcctgtaatcccagctactcaggaggctgaggcaggagaatcgcttgaacccgggaggcagaggttgcagtgagccgagattgcaccactgcactccagcctgagcaacagagtgagactccgttgtctttaaaggccaatcccatagcaaatgacagagactcacttgagtaagaaaggtttttgacaagaaaacccacagaagaagagntaagctgtggatataagaaaggcactacaatctgtatttaaatctaattgcacactagataatatatgtatgaaaaattattt

SEQ ID NO: 369126 - DNA, 4231 bp, Homo sapiens
cgctcccgccccagctcgcgctgcccgggcgggcgccggccgctggcgccgctactgctgccgcccccggggcgcgagtccgccgcccgccgcccgggcacccggcgaggggcgggggcagctccgaaccggccccagatccttcccgcttccgcctcacgcttcccggaaagcttgtccctctccgccgagctgctccgggagccccgccgcgccgagggtatctcccagagccccagctggtgtggccaggccccaggagtaggatggggctccccctacgagggccggtggcagccagaactgatacagcccccctggtctggggccaggacgccagctgaggagggcaggagtgtctggagctatggctggtgcctcggtgaaagtggcagtgagggttcggccctttaacgcccgtgagaccagccaggatgccaagtgtgtggtcagcatgcagggcaacaccacctccatcatcaatcctaaacagagcaaggatgcccccaaaagcttcacctttgactactcctactggtcacacacttcgacggaggacccccagtttgcatctcagcagcaagtgtatcgggacattggagaagagatgctgctccacgcctttgaaggctacaacgtgtgcatctttgcctatgggcagaccggggctgggaaatcctataccatgatggggcgacaggagccagggcagcagggcatcgtgccccagctctgtgaggacctcttctctcgcgttagtgagaaccagagtgctcagctatcctactctgtggaggtgagctatatggagatctactgtgagcgggtacgagacctcttgaaccccaagagtcggggttctctgcgggtccgggagcaccccatcctgggcccgtacgtgcaggacctgtccaaattggctgtgacctcctacgcagacattgctgacctcatggactgtggaaataaagcacggactgtggctgccaccaacatgaatgagaccagcagccgttcccatgccgtctttaccatcgtcttcacacagcgctgccatgaccagctcacggggctggactcggagaaggtcagtaagatcagtttggtggaccttgctgggagtgagcgagccgactcctcaggggcccggggcatgcgcctgaaggaaggagccaacatcaataagtccctgactacactagggaaagtgatctcggcccttgcagatatgcaatcaaagaagcgaaagtcggattttatcccctacagggactctgtgctcacctggctgctcaaggaaaatttgggggggaactcacgcacagccatgattgcagccctgagccctgctgacatcaattacgaggagactctcagcaccctcaggtatgctgaccgcaccaagcaaatccgctgcaatgccatcatcaacgaggaccctaatgcccggctgattagagagctgcaggaggaagtagcccggctgcgggaactgctgatggctcagggactgtcagcctctgctctggaaggcctgaagacggaagaagggagtgtcagaggcgccctgccagctgtgtcatctcccccagctccagtttcaccctcatcacccaccacacataatggggagctggagccgtcattctcccccaacacggagtcccagattgggcctgaggaagccatggagaggctgcaggagacagagaagattatagctgagctgaacgagacatgggaggagaagctacgcaagacagaagccctgaggatggagagagaagcattgctggctgagatgggggtggccgtccgggaggatgggggaactgtgggcgtcttctctccaaagaagactccccacctggtgaacctgaacgaagaccctctgatgtctgagtgtctgctctaccacatcaaagatggcgtcaccagggtcggccaagtagatatggacatcaagctgaccggacagttcattcgggagcaacactgtctgttccggagcatcccccagccagatggagaagtggtggtcactctggagccttgtgaaggagctgagacatatgtgaatgggaagcttgtgacggagccgctggtgctgaagtcagggaataggattgtgatgggcaagaaccacgttttccgcttcaaccacccggagcaggcaaggctggaacgggaacgaggggtccccccacccccaggaccgccctctgagccagtcgactggaactttgcccagaaggaactgctggagcagcaaggcatcgacataaagctggaaatggagaagaggctgcaggatctggagaatcagtaccggaaagaaaaggaagaagccgatcttctgctggagcagcagcgactgtatgcagactcggacagcggggatgactctgacaagcgctcttgtgaagagagctggaggctcatctcctccttgcgggagcagctgccgcccaccacggtccagaccattgtcaaacgctgtggtctgcccagcagtggcaagcgcagggcccctcgcagggtttatcagatcccccagcgacgcaggctgcagggcaaagacccccgctgggccaccatggctgacctgaagatgcaggcggtgaaggagatctgctacgaggtggccctggctgacttccgccacgggcgggctgagattgaggccctggccgccctcaagatgcgggagctgtgtcgcacctatggcaagccagacggccccggagacgcctggagggctgtggcccgggatgtctgggacactgtaggcgaggaggaaggaggtggagctggcagtggtggtggcagtgaggagggagcccgaggggcggaggtggaggacctccgggcccacatcgacaagctgacggggattctgcaggaggtgaagctgcagaacagcagcaaggaccgggagctgcaggccctgcgggaccgcatgctccgcatggagagggtcatccccctggcccaggatcatgaggatgagaatgaagaaggtggtgaggtcccctgggccccgcctgaaggatcagaggcagcagaggaggcagcccccagtgaccgcatgccgtcagcccggcccccctcgccgccactgtcaagctgggagcgggtgtcacggctcatggaggaggaccctgccttccgtcgtggtcgtcttcgctggctcaagcaggagcagctacggctgcagggactgcagggctctgggggccggggcggggggctgcgcaggcccccagcccgctttgtgccccctcacgactgcaagctacgcttccccttcaagagcaacccccagcaccgggagtcttggccagggatggggagcggggaggctccaactccgctccaaccccctgaggaggtcactccccatccagccacccctgcccgccggcctccgagtccccgaaggtcccaccatccccgcaggaactccctggatggagggggccgatcccggggagcgggttctgcacagcctgaaccccagcacttccagcccaaaaagcacaactcttatccccagccaccccaaccctacccagcccagcggcccccagggccccgctaccccccatacactactcccccacgaatgagacggcagcgttctgcccctgacctcaaggagagtggggcagctgtgtgagtcccacatcctgggcagagggcctggtggggccccttgctaggagaagggaagacgcccgagacgctgcttccccagaagtgctggggcagggaggcccaggagatgagagagaaggtccgagtaggtgatagaagacaagggggagaccgagccggaggctgaggaaaggaagagggcacggagttgccaggagcaaaccaaagtgaagagagagataggaagctgcctcggggccaccccttgcaaagggggtgtgtcccacaaacgctgctatgggtggggtggggggctggggtgctgcgtagccagtgtttgactttcttttcaagtgggggaaagtgggagaggactgagagtgaggcaagttctccccagcccctgtccgtctgtctgtctgtctgtggtggtttctgtttcttgggaggcatggtaggatcataagtcattcccctccccttccaggcctcctgctatatttgggggacctgactggtttggctggagtcccatgaggatgtgggccctttaataaaggatagcaaacaggga

SEQ ID NO: 369127 - DNA, 3918 bp, Homo sapiens
ggcaagaccagaaggactcctgcaacggtgactctggagggcccctgatctgcaacgggtacttgcagggccttgtgtctttcggaaaagcaccgtgtggccaagttggcgtgccaggtgtctacaccaacctctgcaaattcactgagtggatagagaaaaccgtccaggccagttaactctggggactgggaacccatgaaattgacccccaaatacatcctgcggaaggaattcacggaggacccccagtttgcatctcagcagcaagtgtatcgggacattggagaagagatgctgctccacgcctttgaaggctacaacgtgtgcatctttgcctatgggcagaccggggctgggaaatcctataccatgatggggcgacaggagccagggcagcagggcatcgtgccccagctctgtgaggacctcttctctcgcgttagtgagaaccagagtgctcagctatcctactctgtggaggtgagctatatggagatctactgtgagcgggtacgagacctcttgaaccccaagagtcggggttctctgcgggtccgggagcaccccatcctgggcccgtacgtgcaggacctgtccaaattggctgtgacctcctacgcagacattgctgacctcatggactgtggaaataaagcacggactgtggctgccaccaacatgaatgagaccagcagccgttcccatgccgtctttaccatcgtcttcacacagcgctgccatgaccagctcacggggctggactcggagaaggtcagtaagatcagtttggtggaccttgctgggagtgagcgagccgactcctcaggggcccggggcatgcgcctgaaggaaggagccaacatcaataagtccctgactacactagggaaagtgatctcggcccttgcagatatgcaatcaaagaagcgaaagtcggattttatcccctacagggactctgtgctcacctggctgctcaaggaaaatttgggggggaactcacgcacagccatgattgcagccctgagccctgctgacatcaattacgaggagactctcagcaccctcaggtatgctgaccgcaccaagcaaatccgctgcaatgccatcatcaacgaggaccctaatgcccggctgattagagagctgcaggaggaagtagcccggctgcgggaactgctgatggctcagggactgtcagcctctgctctggaaggcctgaagacggaagaagggagtgtcagaggcgccctgccagctgtgtcatctcccccagctccagtttcaccctcatcacccaccacacataatggggagctggagccgtcattctcccccaacacggagtcccagattgggcctgaggaagccatggagaggctgcaggagacagagaagattatagctgagctgaacgagacatgggaggagaagctacgcaagacagaagccctgaggatggagagagaagcattgctggctgagatgggggtggccgtccgggaggatgggggaactgtgggcgtcttctctccaaagaagactccccacctggtgaacctgaacgaagaccctctgatgtctgagtgtctgctctaccacatcaaagatggcgtcaccagggtcggccaagtagatatggacatcaagctgaccggacagttcattcgggagcaacactgtctgttccggagcatcccccagccagatggagaagtggtggtcactctggagccttgtgaaggagctgagacatatgtgaatgggaagcttgtgacggagccgctggtgctgaagtcagggaataggattgtgatgggcaagaaccacgttttccgcttcaaccacccggagcaggcaaggctggaacgggaacgaggggtccccccacccccaggaccgccctctgagccagtcgactggaactttgcccagaaggaactgctggagcagcaaggcatcgacataaagctggaaatggagaagaggctgcaggatctggagaatcagtaccggaaagaaaaggaagaagccgatcttctgctggagcagcagcgactgtatgcagactcggacagcggggatgactctgacaagcgctcttgtgaagagagctggaggctcatctcctccttgcgggagcagctgccgcccaccacggtccagaccattgtcaaacgctgtggtctgcccagcagtggcaagcgcagggcccctcgcagggtttatcagatcccccagcgacgcaggctgcagggcaaagacccccgctgggccaccatggctgacctgaagatgcaggcggtgaaggagatctgctacgaggtggccctggctgacttccgccacgggcgggctgagattgaggccctggccgccctcaagatgcgggagctgtgtcgcacctatggcaagccagacggccccggagacgcctggagggctgtggcccgggatgtctgggacactgtaggcgaggaggaaggaggtggagctggcagtggtggtggcagtgaggagggagcccgaggggcggaggtggaggacctccgggcccacatcgacaagctgacggggattctgcaggaggtgaagctgcagaacagcagcaaggaccgggagctgcaggccctgcgggaccgcatgctccgcatggagagggtcatccccctggcccaggatcatgaggatgagaatgaagaaggtggtgaggtcccctgggccccgcctgaaggatcagaggcagcagaggaggcagcccccagtgaccgcatgccgtcagcccggcccccctcgccgccactgtcaagctgggagcgggtgtcacggctcatggaggaggaccctgccttccgtcgtggtcgtcttcgctggctcaagcaggagcagctacggctgcagggactgcagggctctgggggccggggcggggggctgcgcaggcccccagcccgctttgtgccccctcacgactgcaagctacgcttccccttcaagagcaacccccagcaccgggagtcttggccagggatggggagcggggaggctccaactccgctccaaccccctgaggaggtcactccccatccagccacccctgcccgccggcctccgagtccccgaaggtcccaccatccccgcaggaactccctggatggagggggccgatcccggggagcgggttctgcacagcctgaaccccagcacttccagcccaaaaagcacaactcttatccccagccaccccaaccctacccagcccagcggcccccagggccccgctaccccccatacactactcccccacgaatgagacggcagcgttctgcccctgacctcaaggagagtggggcagctgtgtgagtcccacatcctgggcagagggcctggtggggccccttgctaggagaagggaagacgcccgagacgctgcttccccagaagtgctggggcagggaggcccaggagatgagagagaaggtccgagtaggtgatagaagacaagggggagaccgagccggaggctgaggaaaggaagagggcacggagttgccaggagcaaaccaaagtgaagagagagataggaagctgcctcggggccaccccttgcaaagggggtgtgtcccacaaacgctgctatgggtggggtggggggctggggtgctgcgtagccagtgtttgactttcttttcaagtgggggaaagtgggagaggactgagagtgaggcaagttctccccagcccctgtccgtctgtctgtctgtctgtggtggtttctgtttcttgggaggcatggtaggatcataagtcattcccctccccttccaggcctcctgctatatttgggggacctgactggtttggctggagtcccatgaggatgtgggccctttaataaaggatagcaaacaggga

SEQ ID NO: 369128 - DNA, 4119 bp, Homo sapiens
cgctcccgccccagctcgcgctgcccgggcgggcgccggccgctggcgccgctactgctgccgcccccggggcgcgagtccgccgcccgccgcccgggcacccggcgaggggcgggggcagctccgaaccggccccagatccttcccgcttccgcctcacgcttcccggaaagcttgtccctctccgccgagctgctccgggagccccgccgcgccgagggtatctcccagagccccagctggtgtggccaggccccaggagtaggatggggctccccctacgagggccggtggcagccagaactgatacagcccccctggtctggggccaggacgccagctgaggagggcaggagtgtctggagctatggctggtgcctcggtgaaagtggcagtgagggttcggccctttaacgcccgtgagaccagccaggatgccaagtgtgtggtcagcatgcagggcaacaccacctccatcatcaatcctaaacagagcaaggatgcccccaaaagcttcacctttgactactcctactggtcacacacttcgacggaggacccccagtttgcatctcagcagcaagtgtatcgggacattggagaagagatgctgctccacgcctttgaaggctacaacgtgtgcatctttgcctatgggcagaccggggctgggaaatcctataccatgatggggcgacaggagccagggcagcagggcatcgtgccccagctctgtgaggacctcttctctcgcgttagtgagaaccagagtgctcagctatcctactctgtggaggtgagctatatggagatctactgtgagcgggtacgagacctcttgaaccccaagagtcggggttctctgcgggtccgggagcaccccatcctgggcccgtacgtgcaggacctgtccaaattggctgtgacctcctacgcagacattgctgacctcatggactgtggaaataaagcacggactgtggctgccaccaacatgaatgagaccagcagccgttcccatgccgtctttaccatcgtcttcacacagcgctgccatgaccagctcacggggctggactcggagaaggtcagtaagatcagtttggtggaccttgctgggagtgagcgagccgactcctcaggggcccggggcatgcgcctgaaggaaggagccaacatcaataagtccctgactacactagggaaagtgatctcggcccttgcagatatgcaatcaaagaagcgaaagtcggattttatcccctacagggactctgtgctcacctggctgctcaaggaaaatttgggggggaactcacgcacagccatgattgcagccctgagccctgctgacatcaattacgaggagactctcagcaccctcaggtatgctgaccgcaccaagcaaatccgctgcaatgccatcatcaacgaggaccctaatgcccggctgattagagagctgcaggaggaagtagcccggctgcgggaactgctgatggctcagggactgtcagcctctgctctggaaggcctgaagacggaagaagggagtgtcagaggcgccctgccagctgtgtcatctcccccagctccagtttcaccctcatcacccaccacacataatggggagctggagccgtcattctcccccaacacggagtcccagattgggcctgaggaagccatggagaggctgcaggagacagagaagattatagctgagctgaacgagacatgggaggagaagctacgcaagacagaagccctgaggatggagagagaagcattgctggctgagatgggggtggccgtccgggaggatgggggaactgtgggcgtcttctctccaaagaagactccccacctggtgaacctgaacgaagaccctctgatgtctgagtgtctgctctaccacatcaaagatggcgtcaccagggtcggccaagtagatatggacatcaagctgaccggacagttcattcgggagcaacactgtctgttccggagcatcccccagccagatggagaagtggtggtcactctggagccttgtgaaggagctgagacatatgtgaatgggaagcttgtgacggagccgctggtgctgaagtcagggaataggattgtgatgggcaagaaccacgttttccgcttcaaccacccggagcaggcaaggctggaacgggaacgaggggtccccccacccccaggaccgccctctgagccagtcgactggaactttgcccagaaggaactgctggagcagcaaggcatcgacataaagctggaaatggagaagaggctgcaggatctggagaatcagtaccggaaagaaaaggaagaagccgatcttctgctggagcagcagcgactgtatgcagactcggacagcggggatgactctgacaagcgctcttgtgaagagagctggaggctcatctcctccttgcgggagcagctgccgcccaccacggtccagaccattgtcaaacgctgtggtctgcccagcagtggcaagcgcagggcccctcgcagggtttatcagatcccccagcgacgcaggctgcagggcaaagacccccgctgggccaccatggctgacctgaagatgcaggcggtgaaggagatctgctacgaggtggccctggctgacttccgccacgggcgggctgagattgaggccctggccgccctcaagatgcgggagctgtgtcgcacctatggcaagccagacggccccggagacgcctggagggctgtggcccgggatgtctgggacactgtaggcgaggaggaaggaggtggagctggcagtggtggtggcagtgaggagggagcccgaggggcggaggtggaggacctccgggcccacatcgacaagctgacggggattctgcaggaggtgaagctgcagaacagcagcaaggaccgggagctgcaggccctgcgggaccgcatgctccgcatggagagggtcatccccctggcccaggatcatgaggatgagaatgaagaaggtggtgaggtcccctgggccccgcctgaaggatcagaggcagcagaggaggcagcccccagtgaccgcatgccgtcagcccggcccccctcgccgccactgtcaagctgggagcgggtgtcacggctcatggaggaggaccctgccttccgtcgtggtcgtcttcgctggctcaagcaggagcagctacggctgcagggactgcagggctctgggggccggggcggggggctgcgcaggcccccagcccgctttgtgccccctcacgactgcaagctacgcttccccttcaagagcaacccccagcaccgggagtcttggccagggatggggagcggggaggctccaactccgctccaaccccctgaggaggtcactccccatccagccacccctgcccgccggcctccgagtccccgaaggtcccaccatccccgcaggaactccctggatggagggggccgatcccggggagcgggttctgcacagcctgaaccccagcacttccagcccaaaaagcacaactcttatccccagccaccccaaccctacccagcccagcggcccccagggccccgctaccccccatacactactcccccacgaatgagacggcagcgttctgcccctgacctcaaggagagtggggcagctgtgtgagtcccacatcctgggcagagggcctggtggggccccttgctaggagaagggaagacgcccgagacgctgcttccccagaagtgctggggcagggaggcccaggagatgagagagaaggtccgagtaggtgatagaagacaagggggagaccgagccggaggctgaggaaaggaagagggcacggagttgccagtagccagtgtttgactttcttttcaagtgggggaaagtgggagaggactgagagtgaggcaagttctccccagcccctgtccgtctgtctgtctgtctgtggtggtttctgtttcttgggaggcatggtaggatcataagtcattcccctccccttccaggcctcctgctatatttgggggacctgactggtttggctggagtcccatgaggatgtgggccctttaataaaggatagcaaacaggga

SEQ ID NO: 369129 - DNA, 2697 bp, Homo sapiens
agctcttggtctcctggatgtctctcatcagctccttctttccttagcctcattctttttcctctttctccctcccaggcctgaagacggaagaagggagtgtcagaggcgccctgccagctgtgtcatctcccccagctccagtttcaccctcatcacccaccacacataatggggagctggagccgtcattctcccccaacacggagtcccagattgggcctgaggaagccatggagaggctgcagagaagcattgctggctgagatgggggtggccgtccgggaggatgggggaactgtgggcgtcttctctccaaagaagactccccacctggtgaacctgaacgaagaccctctgatgtctgagtgtctgctctaccacatcaaagatggcgtcaccagggtcggccaagtagatatggacatcaagctgaccggacagttcattcgggagcaacactgtctgttccggagcatcccccagccagatggagaagtggtggtcactctggagccttgtgaaggagctgagacatatgtgaatgggaagcttgtgacggagccgctggtgctgaagtcagggaataggattgtgatgggcaagaaccacgttttccgcttcaaccacccggagcaggcaaggctggaacgggaacgaggggtccccccacccccaggaccgccctctgagccagtcgactggaactttgcccagaaggaactgctggagcagcaaggcatcgacataaagctggaaatggagaagaggctgcaggatctggagaatcagtaccggaaagaaaaggaagaagccgatcttctgctggagcagcagcgactgtatgcagactcggacagcggggatgactctgacaagcgctcttgtgaagagagctggaggctcatctcctccttgcgggagcagctgccgcccaccacggtccagaccattgtcaaacgctgtggtctgcccagcagtggcaagcgcagggcccctcgcagggtttatcagatcccccagcgacgcaggctgcagggcaaagacccccgctgggccaccatggctgacctgaagatgcaggcggtgaaggagatctgctacgaggtggccctggctgacttccgccacgggcgggctgagattgaggccctggccgccctcaagatgcgggagctgtgtcgcacctatggcaagccagacggccccggagacgcctggagggctgtggcccgggatgtctgggacactgtaggcgaggaggaaggaggtggagctggcagtggtggtggcagtgaggagggagcccgaggggcggaggtggaggacctccgggcccacatcgacaagctgacggggattctgcaggaggtgaagctgcagaacagcagcaaggaccgggagctgcaggccctgcgggaccgcatgctccgcatggagagggtcatccccctggcccaggatcatgaggatgagaatgaagaaggtggtgaggtcccctgggccccgcctgaaggatcagaggcagcagaggaggcagcccccagtgaccgcatgccgtcagcccggcccccctcgccgccactgtcaagctgggagcgggtgtcacggctcatggaggaggaccctgccttccgtcgtggtcgtcttcgctggctcaagcaggagcagctacggctgcagggactgcagggctctgggggccggggcggggggctgcgcaggcccccagcccgctttgtgccccctcacgactgcaagctacgcttccccttcaagagcaacccccagcaccgggagtcttggccagggatggggagcggggaggctccaactccgctccaaccccctgaggaggtcactccccatccagccacccctgcccgccggcctccgagtccccgaaggtcccaccatccccgcaggaactccctggatggagggggccgatcccggggagcgggttctgcacagcctgaaccccagcacttccagcccaaaaagcacaactcttatccccagccaccccaaccctacccagcccagcggcccccagggccccgctaccccccatacactactcccccacgaatgagacggcagcgttctgcccctgacctcaaggagagtggggcagctgtgtgagtcccacatcctgggcagagggcctggtggggccccttgctaggagaagggaagacgcccgagacgctgcttccccagaagtgctggggcagggaggcccaggagatgagagagaaggtccgagtaggtgatagaagacaagggggagaccgagccggaggctgaggaaaggaagagggcacggagttgccaggagcaaaccaaagtgaagagagagataggaagctgcctcggggccaccccttgcaaagggggtgtgtcccacaaacgctgctatgggtggggtggggggctggggtgctgcgtagccagtgtttgactttcttttcaagtgggggaaagtgggagaggactgagagtgaggcaagttctccccagcccctgtccgtctgtctgtctgtctgtggtggtttctgtttcttgggaggcatggtaggatcataagtcattcccctccccttccaggcctcctgctatatttgggggacctgactggtttggctggagtcccatgaggatgtgggccctttaataaaggatagcaaacaggga

SEQ ID NO: 369130 - DNA, 3382 bp, Homo sapiens
cgctcccgccccagctcgcgctgcccgggcgggcgccggccgctggcgccgctactgctgccgcccccggggcgcgagtccgccgcccgccgcccgggcacccggcgaggggcgggggcagctccgaaccggccccagatccttcccgcttccgcctcacgcttcccggaaagcttgtccctctccgccgagctgctccgggagccccgccgcgccgagggtatctcccagagccccagctggtgtggccaggccccaggagtaggatggggctccccctacgagggccggtggcagccagaactgatacagcccccctggtctggggccaggacgccagctgaggagggcaggagtgtctggagctatggctggtgcctcggtgaaagtggcagtgagggttcggccctttaacgcccgtgagaccagccaggatgccaagtgtgtggtcagcatgcagggcaacaccacctccatcatcaatcctaaacagagcaaggatgcccccaaaagcttcacctttgactactcctactggtcacacacttcgacggaggacccccagtttgcatctcagcagcaagtgtatcgggacattggagaagagatgctgctccacgcctttgaaggctacaacgtgtgcatctttgcctatgggcagaccggggctgggaaatcctataccatgatggggcgacaggagccagggcagcagggcatcgtgccccagctctgtgaggacctcttctctcgcgttagtgagaaccagagtgctcagctatcctactctgtggaggtgagctatatggagatctactgtgagcgggtacgagacctcttgaaccccaagagtcggggttctctgcgggtccgggagcaccccatcctgggcccgtacgtgcaggacctgtccaaattggctgtgacctcctacgcagacattgctgacctcatggactgtggaaataaagcacggactgtggctgccaccaacatgaatgagaccagcagccgttcccatgccgtctttaccatcgtcttcacacagcgctgccatgaccagctcacggggctggactcggagaaggtcagtaagatcagtttggtggaccttgctgggagtgagcgagccgactcctcaggggcccggggcatgcgcctgaaggaaggagccaacatcaataagtccctgactacactagggaaagtgatctcggcccttgcagatatgcaatcaaagaagcgaaagtcggattttatcccctacagggactctgtgctcacctggctgctcaaggaaaatttgggggggaactcacgcacagccatgattgcagccctgagccctgctgacatcaattacgaggagactctcagcaccctcaggtatgctgaccgcaccaagcaaatccgctgcaatgccatcatcaacgaggaccctaatgcccggctgattagagagctgcaggaggaagtagcccggctgcgggaactgctgatggctcagggactgtcagcctctgctctggaaggcctgaagacggaagaagggagtgtcagaggcgccctgccagctgtgtcatctcccccagctccagtttcaccctcatcacccaccacacataatggggagctggagccgtcattctcccccaacacggagtcccagattgggcctgaggaagccatggagaggctgcaggagacagagaagattatagctgagctgaacgagacatgggaggagaagctacgcaagacagaagccctgaggatggagagagaagcattgctggctgagatgggggtggccgtccgggaggatgggggaactgtgggcgtcttctctccaaagaagactccccacctggtgaacctgaacgaagaccctctgatgtctgagtgtctgctctaccacatcaaagatggcgtcaccagggtcggccaagtagatatggacatcaagctgaccggacagttcattcgggagcaacactgtctgttccggagcatcccccagccagatggagaagtggtggtcactctggagccttgtgaaggagctgagacatatgtgaatgggaagcttgtgacggagccgctggtgctgaagtcagggaataggattgtgatgggcaagaaccacgttttccgcttcaaccacccggagcaggcaaggctggaacgggaacgaggggtccccccacccccaggaccgccctctgagccagtcgactggaactttgcccagaaggaactgctggagcagcaaggcatcgacataaagctggaaatggagaagaggctgcaggatctggagaatcagtaccggaaagaaaaggaagaacaggagcagctacggctgcagggactgcagggctctgggggccggggcggggggctgcgcaggcccccagcccgctttgtgccccctcacgactgcaagctacgcttccccttcaagagcaacccccagcaccgggagtcttggccagggatggggagcggggaggctccaactccgctccaaccccctgaggaggtcactccccatccagccacccctgcccgccggcctccgagtccccgaaggtcccaccatccccgcaggaactccctggatggagggggccgatcccggggagcgggttctgcacagcctgaaccccagcacttccagcccaaaaagcacaactcttatccccagccaccccaaccctacccagcccagcggcccccagggccccgctaccccccatacactactcccccacgaatgagacggcagcgttctgcccctgacctcaaggagagtggggcagctgtgtgagtcccacatcctgggcagagggcctggtggggccccttgctaggagaagggaagacgcccgagacgctgcttccccagaagtgctggggcagggaggcccaggagatgagagagaaggtccgagtaggtgatagaagacaagggggagaccgagccggaggctgaggaaaggaagagggcacggagttgccaggagcaaaccaaagtgaagagagagataggaagctgcctcggggccaccccttgcaaagggggtgtgtcccacaaacgctgctatgggtggggtggggggctggggtgctgcgtagccagtgtttgactttcttttcaagtgggggaaagtgggagaggactgagagtgaggcaagttctccccagcccctgtccgtctgtctgtctgtctgtggtggtttctgtttcttgggaggcatggtaggatcataagtcattcccctccccttccaggcctcctgctatatttgggggacctgactggtttggctggagtcccatgaggatgtgggccctttaataaaggatagcaaacaggga

SEQ ID NO: 369131 - DNA, 2406 bp, Homo sapiens
cacaggcattcgtggctgtccttggtagtcatcttgggtagggagtgagctctcaggatcatcaacctaaggatgggtggaggcctgtggctgagggtgcccgtttctcccagggtcggccaagtagatatggacatcaagctgaccggacagttcattcgggagcaacactgtctgttccggagcatcccccagccagatggagaagtggtggtcactctggagccttgtgaaggagctgagacatatgtgaatgggaagcttgtgacggagccgctggtgctgaagtcagggaataggattgtgatgggcaagaaccacgttttccgcttcaaccacccggagcaggcaaggctggaacgggaacgaggggtccccccacccccaggaccgccctctgagccagtcgactggaactttgcccagaaggaactgctggagcagcaaggcatcgacataaagctggaaatggagaagaggctgcaggatctggagaatcagtaccggaaagaaaaggaagaagccgatcttctgctggagcagcagcgactgtatgcagactcggacagcggggatgactctgacaagcgctcttgtgaagagagctggaggctcatctcctccttgcgggagcagctgccgcccaccacggtccagaccattgtcaaacgctgtggtctgcccagcagtggcaagcgcagggcccctcgcagggtttatcagatcccccagcgacgcaggctgcagggcaaagacccccgctgggccaccatggctgacctgaagatgcaggcggtgaaggagatctgctacgaggtggccctggctgacttccgccacgggcgggctgagattgaggccctggccgccctcaagatgcgggagctgtgtcgcacctatggcaagccagacggccccggagacgcctggagggctgtggcccgggatgtctgggacactgtaggcgaggaggaaggaggtggagctggcagtggtggtggcagtgaggagggagcccgaggggcggaggtggaggacctccgggcccacatcgacaagctgacggggattctgcaggaggtgaagctgcagaacagcagcaaggaccgggagctgcaggccctgcgggaccgcatgctccgcatggagagggtcatccccctggcccaggatcatgaggatgagaatgaagaaggtggtgaggtcccctgggccccgcctgaaggatcagaggcagcagaggaggcagcccccagtgaccgcatgccgtcagcccggcccccctcgccgccactgtcaagctgggagcgggtgtcacggctcatggaggaggaccctgccttccgtcgtggtcgtcttcgctggctcaagcaggagcagctacggctgcagggactgcagggctctgggggccggggcggggggctgcgcaggcccccagcccgctttgtgccccctcacgactgcaagctacgcttccccttcaagagcaacccccagcaccgggagtcttggccagggatggggagcggggaggctccaactccgctccaaccccctgaggaggtcactccccatccagccacccctgcccgccggcctccgagtccccgaaggtcccaccatccccgcaggaactccctggatggagggggccgatcccggggagcgggttctgcacagcctgaaccccagcacttccagcccaaaaagcacaactcttatccccagccaccccaaccctacccagcccagcggcccccagggccccgctaccccccatacactactcccccacgaatgagacggcagcgttctgcccctgacctcaaggagagtggggcagctgtgtgagtcccacatcctgggcagagggcctggtggggccccttgctaggagaagggaagacgcccgagacgctgcttccccagaagtgctggggcagggaggcccaggagatgagagagaaggtccgagtaggtgatagaagacaagggggagaccgagccggaggctgaggaaaggaagagggcacggagttgccaggagcaaaccaaagtgaagagagagataggaagctgcctcggggccaccccttgcaaagggggtgtgtcccacaaacgctgctatgggtggggtggggggctggggtgctgcgtagccagtgtttgactttcttttcaagtgggggaaagtgggagaggactgagagtgaggcaagttctccccagcccctgtccgtctgtctgtctgtctgtggtggtttctgtttcttgggaggcatggtaggatcataagtcattcccctccccttccaggcctcctgctatatttgggggacctgactggtttggctggagtcccatgaggatgtgggccctttaataaaggatagcaaacaggga

SEQ ID NO: 369132 - DNA, 1923 bp, Homo sapiens
gcgcctgttacggtccggaattttgtggcatggaacgaagccgatcttctgctggagcagcagcgactgtatgcagactcggacagcggggatgactctgacaagcgctcttgtgaagagagctggaggctcatctcctccttgcgggagcagctgccgcccaccacggtccagaccattgtcaaacgctgtggtctgcccagcagtggcaagcgcagggcccctcgcagggtttatcagatcccccagcgacgcaggctgcagggcaaagacccccgctgggccaccatggctgacctgaagatgcaggcggtgaaggagatctgctacgaggtggccctggctgacttccgccacgggcgggctgagattgaggccctggccgccctcaagatgcgggagctgtgtcgcacctatggcaagccagacggccccggagacgcctggagggctgtggcccgggatgtctgggacactgtaggcgaggaggaaggaggtggagctggcagtggtggtggcagtgaggagggagcccgaggggcggaggtggaggacctccgggcccacatcgacaagctgacggggattctgcaggaggtgaagctgcagaacagcagcaaggaccgggagctgcaggccctgcgggaccgcatgctccgcatggagagggtcatccccctggcccaggatcatgaggatgagaatgaagaaggtggtgaggtcccctgggccccgcctgaaggatcagaggcagcagaggaggcagcccccagtgaccgcatgccgtcagcccggcccccctcgccgccactgtcaagctgggagcgggtgtcacggctcatggaggaggaccctgccttccgtcgtggtcgtcttcgctggctcaagcaggagcagctacggctgcagggactgcagggctctgggggccggggcggggggctgcgcaggcccccagcccgctttgtgccccctcacgactgcaagctacgcttccccttcaagagcaacccccagcaccgggagtcttggccagggatggggagcggggaggctccaactccgctccaaccccctgaggaggtcactccccatccagccacccctgcccgccggcctccgagtccccgaaggtcccaccatccccgcaggaactccctggatggagggggccgatcccggggagcgggttctgcacagcctgaaccccagcacttccagcccaaaaagcacaactcttatccccagccaccccaaccctacccagcccagcggcccccagggccccgctaccccccatacactactcccccacgaatgagacggcagcgttctgcccctgacctcaaggagagtggggcagctgtgtgagtcccacatcctgggcagagggcctggtggggccccttgctaggagaagggaagacgcccgagacgctgcttccccagaagtgctggggcagggaggcccaggagatgagagagaaggtccgagtaggtgatagaagacaagggggagaccgagccggaggctgaggaaaggaagagggcacggagttgccaggagcaaaccaaagtgaagagagagataggaagctgcctcggggccaccccttgcaaagggggtgtgtcccacaaacgctgctatgggtggggtggggggctggggtgctgcgtagccagtgtttgactttcttttcaagtgggggaaagtgggagaggactgagagtgaggcaagttctccccagcccctgtccgtctgtctgtctgtctgtggtggtttctgtttcttgggaggcatggtaggatcataagtcattcccctccccttccaggcctcctgctatatttgggggacctgactggtttggctggagtcccatgaggatgtgggccctttaataaaggatagcaaacaggga

SEQ ID NO: 369133 - DNA, 2375 bp, Homo sapiens
cgctcccgccccagctcgcgctgcccgggcgggcgccggccgctggcgccgctactgctgccgcccccggggcgcgagtccgccgcccgccgcccgggcacccggcgaggggcgggggcagctccgaaccggccccagatccttcccgcttccgcctcacgcttcccggaaagcttgtccctctccgccgagctgctccgggagccccgccgcgccgagggtatctcccagagccccagctggtgtggccaggccccaggagtaggatggggctccccctacgagggccggtggcagccagaactgatacagcccccctggtctggggccaggacgccagctgaggagggcaggagtgtctggagctatggctggtgcctcggtgaaagtggcagtgagggttcggccctttaacgcccgtgagaccagccaggatgccaagtgtgtggtcagcatgcagggcaacaccacctccatcatcaatcctaaacagagcaaggatgcccccaaaagcttcacctttgactactcctactggtcacacacttcgacggaggacccccagtttgcatctcagcagcaagtgtatcgggacattggagaagagatgctgctccacgcctttgaaggctacaacgtgtgcatctttgcctatgggcagaccggggctgggaaatcctataccatgatggggcgacaggagccagggcagcagggcatcgtgccccagctctgtgaggacctcttctctcgcgttagtgagaaccagagtgctcagctatcctactctgtggaggtgagctatatggagatctactgtgagcgggtacgagacctcttgaaccccaagagtcggggttctctgcgggtccgggagcaccccatcctgggcccgtacgtgcaggacctgtccaaattggctgtgacctcctacgcagacattgctgacctcatggactgtggaaataaagcacggactgtggctgccaccaacatgaatgagaccagcagccgttcccatgccgtctttaccatcgtcttcacacagcgctgccatgaccagctcacggggctggactcggagaaggtcagtaagatcagtttggtggaccttgctgggagtgagcgagccgactcctcaggggcccggggcatgcgcctgaaggaaggagccaacatcaataagtccctgactacactagggaaagtgatctcggcccttgcagatatgcaatcaaagaagcgaaagtcggattttatcccctacagggactctgtgctcacctggctgctcaaggaaaatttgggggggaactcacgcacagccatgattgcagccctgagccctgctgacatcaattacgaggagactctcagcaccctcaggtatgctgaccgcaccaagcaaatccgctgcaatgccatcatcaacgaggaccctaatgcccggctgattagagagctgcaggaggaagtagcccggctgcgggaactgctgatggctcagggactgtcagcctctgctctggaaggcctgaagacggaagaagggagtgtcagaggcgccctgccagctgtgtcatctcccccagctccagtttcaccctcatcacccaccacacataatggggagctggagccgtcattctcccccaacacggagtcccagattgggcctgaggaagccatggagaggctgcaggagacagagaagattatagctgagctgaacgagacatgggaggagaagctacgcaagacagaagccctgaggatggagagagaagcattgctggctgagatgggggtggccgtccgggaggatgggggaactgtgggcgtcttctctccaaagaaggtgagtgaggaatcgagcgaggaggcctagagagctctctggatgcctagaaaagaggcagcaggtgcagggtagtgagtgctgtccctgatcgctccctttgaggtccccggcttgtccctccatcatttctgtcccctcccctgccacctcctctccgtcttgtttagtcatccctgccttctcccttcagccattcaacagtcagcctcaggagagggagaggacctgggaaatcggaggttggttgcaatagagcatgcttttgtatcatttgagttttgtattctgtgcatgctcaaaaagataactaaagaaatctatttttcagaaggataacttgggaagacaagactaaagggaatagaggaggcatgagcactacattgtaagacagtggttgccagtgcagcgaggggttggttatagatggaggcacccgtgtagcttggagctatgctgcaactggtttcctggaggaggtggtttggaaagtggaacctgaaagatggacagg

SEQ ID NO: 369134 - DNA, 1450 bp, Homo sapiens
cgctcccgccccagctcgcgctgcccgggcgggcgccggccgctggcgccgctactgctgccgcccccggggcgcgagtccgccgcccgccgcccgggcacccggcgaggggcgggggcagctccgaaccggccccagatccttcccgcttccgcctcacgcttcccggaaagcttgtccctctccgccgagctgctccgggagccccgccgcgccgagggtatctcccagagccccagctggtgtggccaggccccaggagtaggatggggctccccctacgagggccggtggcagccagaactgatacagcccccctggtctggggccaggacgccagctgaggagggcaggagtgtctggagctatggctggtgcctcggtgaaagtggcagtgagggttcggccctttaacgcccgtgagaccagccaggatgccaagtgtgtggtcagcatgcagggcaacaccacctccatcatcaatcctaaacagagcaaggatgcccccaaaagcttcacctttgactactcctactggtcacacacttcgacggaggacccccagtttgcatctcagcagcaagtgtatcgggacattggagaagagatgctgctccacgcctttgaaggctacaacgtgtgcatctttgcctatgggcagaccggggctgggaaatcctataccatgatggggcgacaggagccagggcagcagggcatcgtgccccagctctgtgaggacctcttctctcgcgttagtgagaaccagagtgctcagctatcctactctgtggaggtgagctatatggagatctactgtgagcgggtacgagacctcttgaaccccaagagtcggggttctctgcgggtccgggagcaccccatcctgggcccgtacgtgcaggacctgtccaaattggctgtgacctcctacgcagacattgctgacctcatggactgtggaaataaagcacggactgtggctgccaccaacatgaatgagaccagcagcctggctctgaacttaggcatgctttatcttgccccctcggccctctctttctgacccccctttgctgctggttccctgagtctgtgccccttgaacccttcactctccctgatcacttgacttcactccctgccccctgcgccttcatggatctagagttcttagccccgtcctcccttaaacctgacttccgcccacagcaaccagctccctgaccacagggctgctcctcagcctcctggtcttattggtcctggtgatgcttggtgccagctactggtaccgtgcccgcctgcaccagcgactctgccagctcaagggacccacctgccagtacaggtacgagcatcacctccctgctaccacttccattcaactggggacagtgctgaagctgcctcacctctcagccctgccacctaagatcagagccggcgt

SEQ ID NO: 369135 - DNA, 433 bp, Homo sapiens
cgacaagctgacggggattctgcaggaggtgaagctgcagaacagcagcaaggaccgggagctgcaggccctgcgggaccgcatgctccgcatggagagggtcatccccctggcccaggtaggactggccttctgcctcccttctctcctccctcggctcttcactttaggagtctgaaccttccatctcagagcctaaccttccccaagtctggaaaaaattgcattgaagtatagtacgtttttttcaatattgtttacgaaccacatgcctcgctgtcaccaggctgctaattaaaatagattcccgggttccaccccagacctactgaatccacatctttggggacaaatctgcatttataataagctctgggtgtttctgaaatacagtgaagtctaagacccactgatataaagtttgcagttttgt

SEQ ID NO: 369136 - DNA, 356 bp, Homo sapiens
atccttctcaataatgtatagcttcagtctaatcctgagaaaacatcagacaaacccaaactgagatgcattctagaaaatagctgatattcttcagaagttccaaggtcatgaaagacaggatagactaagaaactgtgaaagatgagacaagaccaaggacataggacaactaaacatgatgtgggattctgaattgtatcctagaacagaaaaactaaaatcatgaaaaaaatggtgaaatgcaaataatttcttggttttgaaaattattttgtgggctgggcacggtggctcacacctgtaatcctaaaactttgggaggccaaggtgggtggatcacctgaggtcaagag

SEQ ID NO: 369137 - DNA, 1038 bp, Homo sapiens
  misc_feature (995)..(995): n is a, c, g, or t
aggggacaagtctaggaggtctctgaggttactgtacccatccctccttcatctccctccagcatttgtttctggaaggagtcaacaccaacagctctgacctgggcagccttcctgagaaaatgcagccattcctcctcctgttggcctttcttctgacccctggggctgggacagaggagatcatcgggggccatgaggccaagccccactcccgcccctacatggcctttgttcagtttctgcaagagaagagtcggaagaggtgtggcggcatcctagtgagaaaggactttgtgctgacagctgctcactgccagggaagctccataaatgtcaccttgggggcccacaatatcaaggaacaggagcggacccagcagtttatccctgtgaaaagacccatcccccatccagcctataatcctaagaacttctccaacgacatcatgctactgcagctggagagaaaggccaagtggaccacagctgtgcggcctctcaggctacctagcagcaaggcccaggtgaagccagggcagctgtgcagtgtggctggctggggttatgtctcaatgagcactttagcaaccacactgcaggaagtgttgctgacagtgcagaaggactgccagtgtgaacgtctcttccatggcaattacagcagagccactgagatttgtgtgggggatccaaagaagacacagaccggtttcaagggggactccggggggcccctcgtgtgtaaggacgtagcccaaggtattctctcctatggaaacaaaaaagggacacctccaggagtctacatcaaggtctcacacttcctgccctggataaagagaacaatgaagcgcctctaacagcaggcatgagactaaccttcctctgggcctgaccatctctgggacagaggcaagaatccccaaggggtgggcagtcggggttgcaggactgtaataaatggatctctggtgtaaataaagaccgatgcngccgaatacgccaccccgcattggcggcagctgagacctgaga

SEQ ID NO: 369138 - DNA, 621 bp, Homo sapiens
  misc_feature (578)..(578): n is a, c, g, or t
cctataatcctaagaacttctccaacgacatcatgctactgcagctggagagaaaggccaagtggaccacagctgtgcggcctctcaggctacctagcagcaaggcccaggtgaagccagggcagctgtgcagtgtggctggctggggttatgtctcaatgagcactttagcaaccacactgcaggaagtgttgctgacagtgcagaaggactgccagtgtgaacgtctcttccatggcaattacagcagagccactgagatttgtgtgggggatccaaagaagacacagaccggtttcaagggggactccggggggcccctcgtgtgtaaggacgtagcccaaggtattctctcctatggaaacaaaaaagggacacctccaggagtctacatcaaggtctcacacttcctgccctggataaagagaacaatgaagcgcctctaacagcaggcatgagactaaccttcctctgggcctgaccatctctgggacagaggcaagaatccccaaggggtgggcagtcggggttgcaggactgtaataaatggatctctggtgtaaataaagaccgatgcngccgaatacgccaccccgcattggcggcagctgagacctgaga

SEQ ID NO: 369139 - DNA, 917 bp, Homo sapiens
ctgaggttactgtacccatccctccttcatctccctccagcatttgtttctggaaggagtcaacaccaacagctctgacctgggcagccttcctgagaaaatgcagccattcctcctcctgttggcctttcttctgacccctggggctgggacaggtaagtgactatccctattccagaggcctgaacccatcttataagataccctgtacccatgagcactggtcaggaattttcctcaatctgagcccacctcccattccacacccagacttataaatctgaggctagatagacactcagcaaagatcgaaaaatgaagggtgttccctaaaaggtttaatgggtgttagcctctccctagacctctcctttatgacctggagtgtggattgttcttagaaaggcatttggtagggaatgtgaagctaaaaaagataagtaattattactctacactccaacccaggaaagaggagctcagacaccaagttgcagtcataggagttgttactggactcagcttaagaaccacttattcagtgcccccacccagtcacccctgccaggagggaagcccatggtgcaactgatctcagagatggcaagatgactgtgtccatagctctcccattaccttggctccacctgggctttgcgattcatttttagttgatttctccacttccttctgcctttgcaggccctcagctactccactgacctggtgataaccccctctaacatccctgaggtcctgaatcccaccagcactacccccactaaacctcagccaaaggctaattggaggctattcatttatgcaccaaacaacacttactgagaacctagaatgtgttcagccctggcacatgagaattttagaaaatccaactccagaagctcatgggtagatca

SEQ ID NO: 369140 - DNA, 846 bp, Homo sapiens
  misc_feature (803)..(803): n is a, c, g, or t
aggggacaagtctaggaggtctctgaggttactgtacccatccctccttcatctccctccagcatttgtttctggaaggagtcaacaccaacagctctgacctgggcagccttcctgagaaaatgcagccattcctcctcctgttggcctttcttctgacccctggggctgggacagaggagatcatcgggggccatgaggccaagccccactcccgcccctacatggcctttgttcagtttctgcaagagaagagtcggaagaggtgtggcggcatcctagtgagaaaggactttgtgctgacagctgctcactgccagggaagctccataaatgtcaccttgggggcccacaatatcaaggaacaggagcggacccagcagtttatccctgtgaaaagacccatcccccatccagcctataatcctaagaacttctccaacgacatcatgctactgcagctggagagaaaggccaagtggaccacagctgtgcggcctctcaggctacctagcagcaaggcccagggggactccggggggcccctcgtgtgtaaggacgtagcccaaggtattctctcctatggaaacaaaaaagggacacctccaggagtctacatcaaggtctcacacttcctgccctggataaagagaacaatgaagcgcctctaacagcaggcatgagactaaccttcctctgggcctgaccatctctgggacagaggcaagaatccccaaggggtgggcagtcggggttgcaggactgtaataaatggatctctggtgtaaataaagaccgatgcngccgaatacgccaccccgcattggcggcagctgagacctgaga

SEQ ID NO: 369141 - DNA, 1128 bp, Homo sapiens
gcgccgggttgaaatcggacgaggtaacgggagcagagtcggcgggattgagcatttccacagaaattacagttttgtcctttttgaaaaaatagaactgtatttcagaaaaaagaaactacagttttagcatgcagaaaggaaaagggagaacaagccggatcagaagacgaaaactctgcggaagttctgaatcaagaggagtgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagaggttggaatcaactttgttcttaacattaacactatataatttttttccccatttggagatgtgtattttcagttttaataaaaatatcaaaacctt

SEQ ID NO: 369142 - DNA, 1212 bp, Homo sapiens
gacagagggcttcaggcacgcggctgctgctgccactgctgctctgagacaaggtggatgagtctgctgccggatcaagaaaaagaactgtatttcagaaaaaagaaactacagttttagcatgcagaaaggaaaagggagaacaagccggatcagaagacgaaaactctgcggaagttctgaatcaagaggagagatggggtctttctgtgttgggcaggctgggctcaaactcctggcctcaagcagtcctcccgccttggcctcccaaatgctgggaatacagaatgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagaggttggaatcaactttgttcttaacattaacactatataatttttttccccatttggagatgtgtattttcagttttaataaaaatatcaaaacctt

SEQ ID NO: 369143 - DNA, 299 bp, Homo sapiens
aatttatgccctaacagtctgatttttttttttgaatatagaaatacttgttaaatatcttccatcaacagataaacagatggacaaaaagatttctattttaaaggatcatggctatatagagtaagtgtttctctttccctcttaaaattattcctttaggaaattttcatggaaaacctggggttaaattttccatgggggtgagacccctcctgaccctgtatcagctgacgggtaggtattgagcacttactatgtgcagtaaaactgcgcttgatgttgtggaggacaaaagg

SEQ ID NO: 369144 - DNA, 3145 bp, Homo sapiens
agctgccgcccgcggcggaaggggcggacccgggagactgaggacttggattgcttaaggacaccaggcaggcgcgacagccttcagcctctccctctgcagttttggccggttcctttaacttgccttcatctggggctgtttggtatttccacgtgccttgggcccgcccactgcagcctccatcttggaagcggccgccggcgcctaggtgagctagtaggacttccgggtcgggcctccagttgcccgggtaacgggagcagagtcggcgggattgagcatttccacagaaattacagttttgtcctttttgaaaaaatagaactgtatttcagaaaaaagaaactacagttttagcatgcagaaaggaaaagggagaacaagccggatcagaagacgaaaactctgcggaagttctgaatcaagaggagtgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagagaaatacttgttaaatatcttccatcaacagataaacagatggacaaaaagatttctattttaaaggatcatggctatatagaaaatttgacatttggatgggatggaccatcttggaggctactcacagcccttaagttgttatgtctggaagctgagaaatttacatgctggaaaaaagtacttcttggggaggtaatttcagatacgaatgagaagacaagtttggacatagcccagaaaatatgctattatttcatagaagagactaatgctgtgcttcaaaaggtgtctcatatgaaggatgaaaaagaggccctgataaaccaactaactttggtggaatccttgtggacggaagagctaaagattctcagggcatctgccgagaccctgcacagtttgcaaacagcttttacctgatttcaccgaagcgcatttggtcacctcctctgaaacaaaagttaattttgaagagcatcatcatgggctggggtggtggctgcccccaggacatgcaggatttctgcagggggcagcacaggttctgggattgtgaggctgtgagtgaaggtggacaagctgtctggatggcaggtctaatgctcttccgaataaagtgctgaactgtgaggagagaggcggactgtgaggcagccaggagccagctgcgtccgtgtgtggtctgtcaccacggggcctgcttcttatctgacacagcagctatcagagtctagtggttgtgcttttaagatgctctgataccattgggttaaggggcagattggcggtgggtgtggggcagtgtgaggtagtcctggatccccgccagggtggcccagacgccagcccttccctgtgtggctgcactgaggtgggtgttgaagagccccctaggggacacacagcttccaggaggagggaatgtcctctaagcatgctcctggcctctcaaggtggcgcttgtctaattattcacttgggaagaatgactagctcagccagcggctctttctgctttgttctggcgactttcctgggcaggcctttccacctggggagctggctcatcctgcacagctgggccgtggtgggcctgtctgcttgattctggggttcagtgtaggtcagctgatggcgaaccatggtggtggtttggcttctgttcttattcttgagttttgataccacgcagaccttgggtggggagagcttcctgcacagctctcagcggcctgtggccttggaactgcctgcgtaagtaacggaggggctgctggtcctgttcaggcccgtgctggggacgccgcttagacaatgttgcccagagtcctgtttaccctcccagggttcattcttcccaagaactcaaattcctttctcattggagcctagtgaaaccaaatgaacgggacctgctggcctcaggaggcaggcagagtttaaaataaaactttctcatgatttcttgaacatctttccctgtttgtatatacactttgtgtttatttttcagtagctgcagtatattttttttcaatattcagtataatgcagtgtatttcatcatatgctgtatggagagtgggcagacttctgtggagggcccgatagtaaccatttgaagctttctggacctgtggtcttagtcccagcgattctgcagagcggccatcggcagcatgtcaaccatttgcatggctgggctccagggaaactactgacaacgacaggtggtgggccatagtttcctgacccctgtgctatgccagaatttctttttcctcttccctatgagtggacctaaatatgttaattccttttcacctttcaaaacggacagccccttgaacattaaaaactttgcagaccctaaaaaaaaat

SEQ ID NO: 369145 - DNA, 3239 bp, Homo sapiens
agctgccgcccgcggcggaaggggcggacccgggagactgaggacttggattgcttaaggacaccaggcaggcgcgacagccttcagcctctccctctgcagttttggccggttcctttaacttgccttcatctggggctgtttggtatttccacgtgccttgggcccgcccactgcagcctccatcttggaagcggccgccggcgcctaggtgagctagtaggacttccgggtcgggcctccagttgcccgggtaacgggagcagagtcggcgggattgagcatttccacagaaattacagttttgtcctttttgaaaaaatagaactgtatttcagaaaaaagaaactacagttttagcatgcagaaaggaaaagggagaacaagccggatcagaagacgaaaactctgcggaagttctgaatcaagaggagagatggggtctttctgtgttgggcaggctgggctcaaactcctggcctcaagcagtcctcccgccttggcctcccaaatgctgggaatacagaatgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagagaaatacttgttaaatatcttccatcaacagataaacagatggacaaaaagatttctattttaaaggatcatggctatatagaaaatttgacatttggatgggatggaccatcttggaggctactcacagcccttaagttgttatgtctggaagctgagaaatttacatgctggaaaaaagtacttcttggggaggtaatttcagatacgaatgagaagacaagtttggacatagcccagaaaatatgctattatttcatagaagagactaatgctgtgcttcaaaaggtgtctcatatgaaggatgaaaaagaggccctgataaaccaactaactttggtggaatccttgtggacggaagagctaaagattctcagggcatctgccgagaccctgcacagtttgcaaacagcttttacctgatttcaccgaagcgcatttggtcacctcctctgaaacaaaagttaattttgaagagcatcatcatgggctggggtggtggctgcccccaggacatgcaggatttctgcagggggcagcacaggttctgggattgtgaggctgtgagtgaaggtggacaagctgtctggatggcaggtctaatgctcttccgaataaagtgctgaactgtgaggagagaggcggactgtgaggcagccaggagccagctgcgtccgtgtgtggtctgtcaccacggggcctgcttcttatctgacacagcagctatcagagtctagtggttgtgcttttaagatgctctgataccattgggttaaggggcagattggcggtgggtgtggggcagtgtgaggtagtcctggatccccgccagggtggcccagacgccagcccttccctgtgtggctgcactgaggtgggtgttgaagagccccctaggggacacacagcttccaggaggagggaatgtcctctaagcatgctcctggcctctcaaggtggcgcttgtctaattattcacttgggaagaatgactagctcagccagcggctctttctgctttgttctggcgactttcctgggcaggcctttccacctggggagctggctcatcctgcacagctgggccgtggtgggcctgtctgcttgattctggggttcagtgtaggtcagctgatggcgaaccatggtggtggtttggcttctgttcttattcttgagttttgataccacgcagaccttgggtggggagagcttcctgcacagctctcagcggcctgtggccttggaactgcctgcgtaagtaacggaggggctgctggtcctgttcaggcccgtgctggggacgccgcttagacaatgttgcccagagtcctgtttaccctcccagggttcattcttcccaagaactcaaattcctttctcattggagcctagtgaaaccaaatgaacgggacctgctggcctcaggaggcaggcagagtttaaaataaaactttctcatgatttcttgaacatctttccctgtttgtatatacactttgtgtttatttttcagtagctgcagtatattttttttcaatattcagtataatgcagtgtatttcatcatatgctgtatggagagtgggcagacttctgtggagggcccgatagtaaccatttgaagctttctggacctgtggtcttagtcccagcgattctgcagagcggccatcggcagcatgtcaaccatttgcatggctgggctccagggaaactactgacaacgacaggtggtgggccatagtttcctgacccctgtgctatgccagaatttctttttcctcttccctatgagtggacctaaatatgttaattccttttcacctttcaaaacggacagccccttgaacattaaaaactttgcagaccctaaaaaaaaat

SEQ ID NO: 369146 - DNA, 2999 bp, Homo sapiens
gacagagggcttcaggcacgcggctgctgctgccactgctgctctgagacaaggtggatgagtctgctgccggatcaagaaaaagaactgtatttcagaaaaaagaaactacagttttagcatgcagaaaggaaaagggagaacaagccggatcagaagacgaaaactctgcggaagttctgaatcaagaggagagatggggtctttctgtgttgggcaggctgggctcaaactcctggcctcaagcagtcctcccgccttggcctcccaaatgctgggaatacagaatgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagagaaatacttgttaaatatcttccatcaacagataaacagatggacaaaaagatttctattttaaaggatcatggctatatagaaaatttgacatttggatgggatggaccatcttggaggctactcacagcccttaagttgttatgtctggaagctgagaaatttacatgctggaaaaaagtacttcttggggaggtaatttcagatacgaatgagaagacaagtttggacatagcccagaaaatatgctattatttcatagaagagactaatgctgtgcttcaaaaggtgtctcatatgaaggatgaaaaagaggccctgataaaccaactaactttggtggaatccttgtggacggaagagctaaagattctcagggcatctgccgagaccctgcacagtttgcaaacagcttttacctgatttcaccgaagcgcatttggtcacctcctctgaaacaaaagttaattttgaagagcatcatcatgggctggggtggtggctgcccccaggacatgcaggatttctgcagggggcagcacaggttctgggattgtgaggctgtgagtgaaggtggacaagctgtctggatggcaggtctaatgctcttccgaataaagtgctgaactgtgaggagagaggcggactgtgaggcagccaggagccagctgcgtccgtgtgtggtctgtcaccacggggcctgcttcttatctgacacagcagctatcagagtctagtggttgtgcttttaagatgctctgataccattgggttaaggggcagattggcggtgggtgtggggcagtgtgaggtagtcctggatccccgccagggtggcccagacgccagcccttccctgtgtggctgcactgaggtgggtgttgaagagccccctaggggacacacagcttccaggaggagggaatgtcctctaagcatgctcctggcctctcaaggtggcgcttgtctaattattcacttgggaagaatgactagctcagccagcggctctttctgctttgttctggcgactttcctgggcaggcctttccacctggggagctggctcatcctgcacagctgggccgtggtgggcctgtctgcttgattctggggttcagtgtaggtcagctgatggcgaaccatggtggtggtttggcttctgttcttattcttgagttttgataccacgcagaccttgggtggggagagcttcctgcacagctctcagcggcctgtggccttggaactgcctgcgtaagtaacggaggggctgctggtcctgttcaggcccgtgctggggacgccgcttagacaatgttgcccagagtcctgtttaccctcccagggttcattcttcccaagaactcaaattcctttctcattggagcctagtgaaaccaaatgaacgggacctgctggcctcaggaggcaggcagagtttaaaataaaactttctcatgatttcttgaacatctttccctgtttgtatatacactttgtgtttatttttcagtagctgcagtatattttttttcaatattcagtataatgcagtgtatttcatcatatgctgtatggagagtgggcagacttctgtggagggcccgatagtaaccatttgaagctttctggacctgtggtcttagtcccagcgattctgcagagcggccatcggcagcatgtcaaccatttgcatggctgggctccagggaaactactgacaacgacaggtggtgggccatagtttcctgacccctgtgctatgccagaatttctttttcctcttccctatgagtggacctaaatatgttaattccttttcacctttcaaaacggacagccccttgaacattaaaaactttgcagaccctaaaaaaaaat

SEQ ID NO: 369147 - DNA, 2472 bp, Homo sapiens
tttgaaaggattgtgaaaatacaacaacttgtgacagagaccacatagtgctggcaaagctgaacgtatttactctctagctttttacagataaagtttattggcaccaccatgtcctccttccctgggctgtgagtggacgtgaccaataaactgctgatgatctcatctgtgctgtgtcgggtgtcgtggtgtggccacccccagagccctagggcaggactccctccgtcatcaatggggtgaagtcgaggtggatgaaaccggaagtggcattttccctatgcgtagttacatttattgatgggtgtttgaaagctgcacctgactcacattaatattatgtaataacttaatcagctttggagttttacaccttactttaaaaaataccttaacagtttttctttctaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagagaaatacttgttaaatatcttccatcaacagataaacagatggacaaaaagatttctattttaaaggatcatggctatatagaaaatttgacatttggatgggatggaccatcttggaggctactcacagcccttaagttgttatgtctggaagctgagaaatttacatgctggaaaaaagtacttcttggggaggtaatttcagatacgaatgagaagacaagtttggacatagcccagaaaatatgctattatttcatagaagagactaatgctgtgcttcaaaaggtgtctcatatgaaggatgaaaaagaggccctgataaaccaactaactttggtggaatccttgtggacggaagagctaaagattctcagggcatctgccgagaccctgcacagtttgcaaacagcttttacctgatttcaccgaagcgcatttggtcacctcctctgaaacaaaagttaattttgaagagcatcatcatgggctggggtggtggctgcccccaggacatgcaggatttctgcagggggcagcacaggttctgggattgtgaggctgtgagtgaaggtggacaagctgtctggatggcaggtctaatgctcttccgaataaagtgctgaactgtgaggagagaggcggactgtgaggcagccaggagccagctgcgtccgtgtgtggtctgtcaccacggggcctgcttcttatctgacacagcagctatcagagtctagtggttgtgcttttaagatgctctgataccattgggttaaggggcagattggcggtgggtgtggggcagtgtgaggtagtcctggatccccgccagggtggcccagacgccagcccttccctgtgtggctgcactgaggtgggtgttgaagagccccctaggggacacacagcttccaggaggagggaatgtcctctaagcatgctcctggcctctcaaggtggcgcttgtctaattattcacttgggaagaatgactagctcagccagcggctctttctgctttgttctggcgactttcctgggcaggcctttccacctggggagctggctcatcctgcacagctgggccgtggtgggcctgtctgcttgattctggggttcagtgtaggtcagctgatggcgaaccatggtggtggtttggcttctgttcttattcttgagttttgataccacgcagaccttgggtggggagagcttcctgcacagctctcagcggcctgtggccttggaactgcctgcgtaagtaacggaggggctgctggtcctgttcaggcccgtgctggggacgccgcttagacaatgttgcccagagtcctgtttaccctcccagggttcattcttcccaagaactcaaattcctttctcattggagcctagtgaaaccaaatgaacgggacctgctggcctcaggaggcaggcagagtttaaaataaaactttctcatgatttcttgaacatctttccctgtttgtatatacactttgtgtttatttttcagtagctgcagtatattttttttcaatattcagtataatgcagtgtatttcatcatatgctgtatggagagtgggcagacttctgtggagggcccgatagtaaccatttgaagctttctggacctgtggtcttagtcccagcgattctgcagagcggccatcggcagcatgtcaaccatttgcatggctgggctccagggaaactactgacaacgacaggtggtgggccatagtttcctgacccctgtgctatgccagaatttctttttcctcttccctatgagtggacctaaatatgttaattccttttcacctttcaaaacggacagccccttgaacattaaaaactttgcagaccctaaaaaaaaat

SEQ ID NO: 369148 - DNA, 1452 bp, Homo sapiens
agctgccgcccgcggcggaaggggcggacccgggagactgaggacttggattgcttaaggacaccaggcaggcgcgacagccttcagcctctccctctgcagttttggccggttcctttaacttgccttcatctggggctgtttggtatttccacgtgccttgggcccgcccactgcagcctccatcttggaagcggccgccggcgcctaggtgagctagtaggacttccgggtcgggcctccagttgcccgggtaacgggagcagagtcggcgggattgagcatttccacagaaattacagttttgtcctttttgaaaaaatagaactgtatttcagaaaaaagaaactacagttttagcatgcagaaaggaaaagggagaacaagccggatcagaagacgaaaactctgcggaagttctgaatcaagaggagagatggggtctttctgtgttgggcaggctgggctcaaactcctggcctcaagcagtcctcccgccttggcctcccaaatgctgggaatacagaatgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagaggttggaatcaactttgttcttaacattaacactatataatttttttccccatttggagatgtgtattttcagttttaataaaaatatcaaaacctt

SEQ ID NO: 369149 - DNA, 1481 bp, Homo sapiens
tttagactaaggtttgatggactaaatttatatagtttagagtcgatgagttgtgtctactcaacaattaggaacttaatccttttccttttgcttttcctacagaaacgacatgcaggatttctgcagggggcagcacaggttctgggattgtgaggctgtgagtgaaggtggacaagctgtctggatggcaggtctaatgctcttccgaataaagtgctgaactgtgaggagagaggcggactgtgaggcagccaggagccagctgcgtccgtgtgtggtctgtcaccacggggcctgcttcttatctgacacagcagctatcagagtctagtggttgtgcttttaagatgctctgataccattgggttaaggggcagattggcggtgggtgtggggcagtgtgaggtagtcctggatccccgccagggtggcccagacgccagcccttccctgtgtggctgcactgaggtgggtgttgaagagccccctaggggacacacagcttccaggaggagggaatgtcctctaagcatgctcctggcctctcaaggtggcgcttgtctaattattcacttgggaagaatgactagctcagccagcggctctttctgctttgttctggcgactttcctgggcaggcctttccacctggggagctggctcatcctgcacagctgggccgtggtgggcctgtctgcttgattctggggttcagtgtaggtcagctgatggcgaaccatggtggtggtttggcttctgttcttattcttgagttttgataccacgcagaccttgggtggggagagcttcctgcacagctctcagcggcctgtggccttggaactgcctgcgtaagtaacggaggggctgctggtcctgttcaggcccgtgctggggacgccgcttagacaatgttgcccagagtcctgtttaccctcccagggttcattcttcccaagaactcaaattcctttctcattggagcctagtgaaaccaaatgaacgggacctgctggcctcaggaggcaggcagagtttaaaataaaactttctcatgatttcttgaacatctttccctgtttgtatatacactttgtgtttatttttcagtagctgcagtatattttttttcaatattcagtataatgcagtgtatttcatcatatgctgtatggagagtgggcagacttctgtggagggcccgatagtaaccatttgaagctttctggacctgtggtcttagtcccagcgattctgcagagcggccatcggcagcatgtcaaccatttgcatggctgggctccagggaaactactgacaacgacaggtggtgggccatagtttcctgacccctgtgctatgccagaatttctttttcctcttccctatgagtggacctaaatatgttaattccttttcacctttcaaaacggacagccccttgaacattaaaaactttgcagaccctaaaaaaaaat

SEQ ID NO: 369150 - DNA, 3033 bp, Homo sapiens
agctgccgcccgcggcggaaggggcggacccgggagactgaggacttggattgcttaaggacaccaggcaggcgcgacagccttcagcctctccctctgcagttttggccggttcctttaacttgccttcatctggggctgtttggtatttccacgtgccttgggcccgcccactgcagcctccatcttggaagcggccgccggcgcctagaactgtatttcagaaaaaagaaactacagttttagcatgcagaaaggaaaagggagaacaagccggatcagaagacgaaaactctgcggaagttctgaatcaagaggagtgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagagaaatacttgttaaatatcttccatcaacagataaacagatggacaaaaagatttctattttaaaggatcatggctatatagaaaatttgacatttggatgggatggaccatcttggaggctactcacagcccttaagttgttatgtctggaagctgagaaatttacatgctggaaaaaagtacttcttggggaggtaatttcagatacgaatgagaagacaagtttggacatagcccagaaaatatgctattatttcatagaagagactaatgctgtgcttcaaaaggtgtctcatatgaaggatgaaaaagaggccctgataaaccaactaactttggtggaatccttgtggacggaagagctaaagattctcagggcatctgccgagaccctgcacagtttgcaaacagcttttacctgatttcaccgaagcgcatttggtcacctcctctgaaacaaaagttaattttgaagagcatcatcatgggctggggtggtggctgcccccaggacatgcaggatttctgcagggggcagcacaggttctgggattgtgaggctgtgagtgaaggtggacaagctgtctggatggcaggtctaatgctcttccgaataaagtgctgaactgtgaggagagaggcggactgtgaggcagccaggagccagctgcgtccgtgtgtggtctgtcaccacggggcctgcttcttatctgacacagcagctatcagagtctagtggttgtgcttttaagatgctctgataccattgggttaaggggcagattggcggtgggtgtggggcagtgtgaggtagtcctggatccccgccagggtggcccagacgccagcccttccctgtgtggctgcactgaggtgggtgttgaagagccccctaggggacacacagcttccaggaggagggaatgtcctctaagcatgctcctggcctctcaaggtggcgcttgtctaattattcacttgggaagaatgactagctcagccagcggctctttctgctttgttctggcgactttcctgggcaggcctttccacctggggagctggctcatcctgcacagctgggccgtggtgggcctgtctgcttgattctggggttcagtgtaggtcagctgatggcgaaccatggtggtggtttggcttctgttcttattcttgagttttgataccacgcagaccttgggtggggagagcttcctgcacagctctcagcggcctgtggccttggaactgcctgcgtaagtaacggaggggctgctggtcctgttcaggcccgtgctggggacgccgcttagacaatgttgcccagagtcctgtttaccctcccagggttcattcttcccaagaactcaaattcctttctcattggagcctagtgaaaccaaatgaacgggacctgctggcctcaggaggcaggcagagtttaaaataaaactttctcatgatttcttgaacatctttccctgtttgtatatacactttgtgtttatttttcagtagctgcagtatattttttttcaatattcagtataatgcagtgtatttcatcatatgctgtatggagagtgggcagacttctgtggagggcccgatagtaaccatttgaagctttctggacctgtggtcttagtcccagcgattctgcagagcggccatcggcagcatgttcactatcgttatgttggggtcaagtgcagatgcctcagaatgtcagaaggtgggccatagtcatgtttttttcctgtgctgatgtgtagggtatattctagtattcctaatgagtggccttatgatatgatgattcctttttcacctttcatctacgtagatcccctatgtcatatagaataaggcaatacttaaaaaa

SEQ ID NO: 369151 - DNA, 1334 bp, Homo sapiens
agctgccgcccgcggcggaaggggcggacccgggagactgaggacttggattgcttaaggacaccaggcaggcgcgacagccttcagcctctccctctgcagttttggccggttcctttaacttgccttcatctggggctgtttggtatttccacgtgccttgggcccgcccactgcagcctccatcttggaagcggccgccggcgcctagaactgtatttcagaaaaaagaaactacagttttagcatgcagaaaggaaaagggagaacaagccggatcagaagacgaaaactctgcggaagttctgaatcaagaggagtgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtgagaagctgacaagggggcagctattctatttggataggaaggcttccgctgcccagaacctgtggctgtagatgtgggtggcaccacagggagaggtgtcggcggcttcaggtgaccctgtcaggttggcctgacgtcaggaggctcctgttgttcttctagaccccactatccctcccgcagtgcttgccttggccccttttcttcactctgctcttcaggcctacagagcctcgtgctgcatcctctgtccggtctttcccagcagcctgtggtgcggagccttccttccttctccctcgttcctccttccgggactgaagcttagcttgctttcctgccccgtcccttttaaact

SEQ ID NO: 369152 - DNA, 719 bp, Homo sapiens
tttgaaaggattgtgaaaatacaacaacttgtgacagagaccacatagtgctggcaaagctgaacgtatttactctctagctttttacagataaagtttattggcaccaccatgtcctccttccctgggctgtgagtggacgtgaccaataaactgctgatgatctcatctgtgctgtgtcgggtgtcgtggtgtggccacccccagagccctagggcaggactccctccgtcatcaatggggtgaagtcgaggtggatgaaaccggaagtggcattttccctatgcgtagttacatttattgatgggtgtttgaaagctgcacctgactcacattaatattatgtaataacttaatcagctttggagttttacaccttactttaaaaaataccttaacagtttttctttctaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagaggttggaatcaactttgttcttaacattaacactatataatttttttccccatttggagatgtgtattttcagttttaataaaaatatcaaaaccttaagactgacatacatatcactaattttcttctag

SEQ ID NO: 369153 - DNA, 279 bp, Homo sapiens
gtaggacttccgggtcgggcctccagttgcccgggtaacgggagcagagtcggcggggtgcgttccttagtctttcattcatcagcgtaaaaagaactgagtttaggtcgcaggtcccctccagggcaggcattatcgtgtgcgctgcagtaacctctcatcttgtggagtcctacacttagcgcatgttgctccggcgcgctgcgtaaagctgaggagcctgaggcccgaggtccgatgctcgcctggctggcctatggctgcgggagcggtgtgtgt

SEQ ID NO: 369154 - DNA, 373 bp, Homo sapiens
ggtgctctttaggtctcacctctgaagctgactgcccttcaaggattataactcactggaggtcaagacattttctggaatagctttctgactccctgtttcccctgggaatcaaaggctgagagacatccagcttcagccttgtgtaattttgaagttcacattttttttttccataatagttatctctgggaccttgaagttatggtaggatttactctctttctgtctttgctttcctaggtacaggaagagggctgatgagtcaaacatccctgcaggtgagaactgttctttgatccttgaaacccaatgtagattttgctgctttgtttttgcggttcaaacgaagtgaattaaaaaaatttcagac

SEQ ID NO: 369155 - DNA, 3031 bp, Homo sapiens
agctgccgcccgcggcggaaggggcggacccgggagactgaggacttggattgcttaaggacaccaggcaggcgcgacagccttcagcctctccctctgcagttttggccggttcctttaacttgccttcatctggggctgtttggtatttccacgtgccttgggcccgcccactgcagcctccatcttggaagcggccgccggcgcctagaactgtatttcagaaaaaagaaactacagttttagcatgcagaaaggaaaagggagaacaagccggatcagaagacgaaaactctgcggaagttctgaatcaagaggagtgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagagaaatacttgttaaatatcttccatcaacagataaacagatggacaaaaagatttctattttaaaggatcatggctatatagaaaatttgacatttggatgggatggaccatcttggaggctactcacagcccttaagttgttatgtctggaagctgagaaatttacatgctggaaaaaagtacttcttggggaggtaatttcagatacgaatgagaagacaagtttggacatagcccagaaaatatgctattatttcatagaagagactaatgctgtgcttcaaaaggtgtctcatatgaaggatgaaaaagaggccctgataaaccaactaactttggtggaatccttgtggacggaagagctaaagattctcagggcatctgccgagaccctgcacagtttgcaaacagcttttacctgatttcaccgaagcgcatttggtcacctcctctgaaacaaaagttaattttgaagagcatcatcatgggctggggtggtggctgcccccaggacatgcaggatttctgcagggggcagcacaggttctgggattgtgaggctgtgagtgaaggtggacaagctgtctggatggcaggtctaatgctcttccgaataaagtgctgaactgtgaggagagaggcggactgtgaggcagccaggagccagctgcgtccgtgtgtggtctgtcaccacggggcctgcttcttatctgacacagcagctatcagagtctagtggttgtgcttttaagatgctctgataccattgggttaaggggcagattggcggtgggtgtggggcagtgtgaggtagtcctggatccccgccagggtggcccagacgccagcccttccctgtgtggctgcactgaggtgggtgttgaagagccccctaggggacacacagcttccaggaggagggaatgtcctctaagcatgctcctggcctctcaaggtggcgcttgtctaattattcacttgggaagaatgactagctcagccagcggctctttctgctttgttctggcgactttcctgggcaggcctttccacctggggagctggctcatcctgcacagctgggccgtggtgggcctgtctgcttgattctggggttcagtgtaggtcagctgatggcgaaccatggtggtggtttggcttctgttcttattcttgagttttgataccacgcagaccttgggtggggagagcttcctgcacagctctcagcggcctgtggccttggaactgcctgcgtaagtaacggaggggctgctggtcctgttcaggcccgtgctggggacgccgcttagacaatgttgcccagagtcctgtttaccctcccagggttcattcttcccaagaactcaaattcctttctcattggagcctagtgaaaccaaatgaacgggacctgctggcctcaggaggcaggcagagtttaaaataaaactttctcatgatttcttgaacatctttccctgtttgtatatacactttgtgtttatttttcagtagctgcagtatattttttttcaatattcagtataatgcagtgtatttcatcatatgctgtatggagagtgggcagacttctgtggagggcccgatagtaaccatttgaagctttctggacctgtggtcttagtcccagcgattctgcagagcggccatcggcagcatgtcaaccatttgcatggctgggctccagggaaactactgacaacgacaggtggtgggccatagtttcctgacccctgtgctatgccagaatttctttttcctcttccctatgagtggacctaaatatgttaattccttttcacctttcaaaacggacagccccttgaacattaaaaactttgcagaccctaaaaaaaaat

SEQ ID NO: 369156 - DNA, 730 bp, Homo sapiens
tcctttaaactggcttttaattttcaaaggtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagaggttggaatcaactttgttcttaacattaacactatataatttttttccccatttggagatgtgtattttcagttttaataaaaatatcaaaacctt

SEQ ID NO: 369157 - DNA, 3125 bp, Homo sapiens
agctgccgcccgcggcggaaggggcggacccgggagactgaggacttggattgcttaaggacaccaggcaggcgcgacagccttcagcctctccctctgcagttttggccggttcctttaacttgccttcatctggggctgtttggtatttccacgtgccttgggcccgcccactgcagcctccatcttggaagcggccgccggcgcctagaactgtatttcagaaaaaagaaactacagttttagcatgcagaaaggaaaagggagaacaagccggatcagaagacgaaaactctgcggaagttctgaatcaagaggagagatggggtctttctgtgttgggcaggctgggctcaaactcctggcctcaagcagtcctcccgccttggcctcccaaatgctgggaatacagaatgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagagaaatacttgttaaatatcttccatcaacagataaacagatggacaaaaagatttctattttaaaggatcatggctatatagaaaatttgacatttggatgggatggaccatcttggaggctactcacagcccttaagttgttatgtctggaagctgagaaatttacatgctggaaaaaagtacttcttggggaggtaatttcagatacgaatgagaagacaagtttggacatagcccagaaaatatgctattatttcatagaagagactaatgctgtgcttcaaaaggtgtctcatatgaaggatgaaaaagaggccctgataaaccaactaactttggtggaatccttgtggacggaagagctaaagattctcagggcatctgccgagaccctgcacagtttgcaaacagcttttacctgatttcaccgaagcgcatttggtcacctcctctgaaacaaaagttaattttgaagagcatcatcatgggctggggtggtggctgcccccaggacatgcaggatttctgcagggggcagcacaggttctgggattgtgaggctgtgagtgaaggtggacaagctgtctggatggcaggtctaatgctcttccgaataaagtgctgaactgtgaggagagaggcggactgtgaggcagccaggagccagctgcgtccgtgtgtggtctgtcaccacggggcctgcttcttatctgacacagcagctatcagagtctagtggttgtgcttttaagatgctctgataccattgggttaaggggcagattggcggtgggtgtggggcagtgtgaggtagtcctggatccccgccagggtggcccagacgccagcccttccctgtgtggctgcactgaggtgggtgttgaagagccccctaggggacacacagcttccaggaggagggaatgtcctctaagcatgctcctggcctctcaaggtggcgcttgtctaattattcacttgggaagaatgactagctcagccagcggctctttctgctttgttctggcgactttcctgggcaggcctttccacctggggagctggctcatcctgcacagctgggccgtggtgggcctgtctgcttgattctggggttcagtgtaggtcagctgatggcgaaccatggtggtggtttggcttctgttcttattcttgagttttgataccacgcagaccttgggtggggagagcttcctgcacagctctcagcggcctgtggccttggaactgcctgcgtaagtaacggaggggctgctggtcctgttcaggcccgtgctggggacgccgcttagacaatgttgcccagagtcctgtttaccctcccagggttcattcttcccaagaactcaaattcctttctcattggagcctagtgaaaccaaatgaacgggacctgctggcctcaggaggcaggcagagtttaaaataaaactttctcatgatttcttgaacatctttccctgtttgtatatacactttgtgtttatttttcagtagctgcagtatattttttttcaatattcagtataatgcagtgtatttcatcatatgctgtatggagagtgggcagacttctgtggagggcccgatagtaaccatttgaagctttctggacctgtggtcttagtcccagcgattctgcagagcggccatcggcagcatgtcaaccatttgcatggctgggctccagggaaactactgacaacgacaggtggtgggccatagtttcctgacccctgtgctatgccagaatttctttttcctcttccctatgagtggacctaaatatgttaattccttttcacctttcaaaacggacagccccttgaacattaaaaactttgcagaccctaaaaaaaaat

SEQ ID NO: 369158 - DNA, 2826 bp, Homo sapiens
gcgccgggttgaaatcggacgaggtaacgggagcagagtcggcgggattgagcatttccacagaaattacagttttgtcctttttgaaaaaatagaactgtatttcagaaaaaagaaactacagttttagcatgcagaaaggaaaagggagaacaagccggatcagaagacgaaaactctgcggaagttctgaatcaagaggagtgaatgagagccacaagtctgaatttatagagctgaggaagtggctgaaagctaggaagtttcaagattcaaacttagcgcctgcttgttttccaggtacaggaagagggctgatgagtcaaacatccctgcaggtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagagaaatacttgttaaatatcttccatcaacagataaacagatggacaaaaagatttctattttaaaggatcatggctatatagaaaatttgacatttggatgggatggaccatcttggaggctactcacagcccttaagttgttatgtctggaagctgagaaatttacatgctggaaaaaagtacttcttggggaggtaatttcagatacgaatgagaagacaagtttggacatagcccagaaaatatgctattatttcatagaagagactaatgctgtgcttcaaaaggtgtctcatatgaaggatgaaaaagaggccctgataaaccaactaactttggtggaatccttgtggacggaagagctaaagattctcagggcatctgccgagaccctgcacagtttgcaaacagcttttacctgatttcaccgaagcgcatttggtcacctcctctgaaacaaaagttaattttgaagagcatcatcatgggctggggtggtggctgcccccaggacatgcaggatttctgcagggggcagcacaggttctgggattgtgaggctgtgagtgaaggtggacaagctgtctggatggcaggtctaatgctcttccgaataaagtgctgaactgtgaggagagaggcggactgtgaggcagccaggagccagctgcgtccgtgtgtggtctgtcaccacggggcctgcttcttatctgacacagcagctatcagagtctagtggttgtgcttttaagatgctctgataccattgggttaaggggcagattggcggtgggtgtggggcagtgtgaggtagtcctggatccccgccagggtggcccagacgccagcccttccctgtgtggctgcactgaggtgggtgttgaagagccccctaggggacacacagcttccaggaggagggaatgtcctctaagcatgctcctggcctctcaaggtggcgcttgtctaattattcacttgggaagaatgactagctcagccagcggctctttctgctttgttctggcgactttcctgggcaggcctttccacctggggagctggctcatcctgcacagctgggccgtggtgggcctgtctgcttgattctggggttcagtgtaggtcagctgatggcgaaccatggtggtggtttggcttctgttcttattcttgagttttgataccacgcagaccttgggtggggagagcttcctgcacagctctcagcggcctgtggccttggaactgcctgcgtaagtaacggaggggctgctggtcctgttcaggcccgtgctggggacgccgcttagacaatgttgcccagagtcctgtttaccctcccagggttcattcttcccaagaactcaaattcctttctcattggagcctagtgaaaccaaatgaacgggacctgctggcctcaggaggcaggcagagtttaaaataaaactttctcatgatttcttgaacatctttccctgtttgtatatacactttgtgtttatttttcagtagctgcagtatattttttttcaatattcagtataatgcagtgtatttcatcatatgctgtatggagagtgggcagacttctgtggagggcccgatagtaaccatttgaagctttctggacctgtggtcttagtcccagcgattctgcagagcggccatcggcagcatgtcaaccatttgcatggctgggctccagggaaactactgacaacgacaggtggtgggccatagtttcctgacccctgtgctatgccagaatttctttttcctcttccctatgagtggacctaaatatgttaattccttttcacctttcaaaacggacagccccttgaacattaaaaactttgcagaccctaaaaaaaaat

SEQ ID NO: 369159 - DNA, 1278 bp, Homo sapiens
agctgccgcccgcggcggaaggggcggacccgggagactgaggacttggattgcttaaggacaccaggcaggcgcgacagccttcagcctctccctctgcagttttggccggttcctttaacttgccttcatctggggctgtttggtatttccacgtgccttgggcccgcccactgcagcctccatcttggaagcggccgccggcgcctagaactgtatttcagaaaaaagaaactacagttttagcatgcagaaaggaaaagggagaacaagccggatcagaagacgaaaactctgcggaagttctgaatcaagaggagtgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagaggttggaatcaactttgttcttaacattaacactatataatttttttccccatttggagatgtgtattttcagttttaataaaaatatcaaaaccttaagactgacatacatatcactaattttcttctag

SEQ ID NO: 369160 - DNA, 468 bp, Homo sapiens
tcacagataatattaattccttcctcataggattattgtaaggacttaagaatggtgcctggcagataaaaagtcttaagaagatgaatgtctgtttggaagttgaaaagtactctgtgtttggaaagagtggattaaaggatgggaagaggtggagtgggattcatcttgtggaaaaatcagaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcaggtcatcactgaggccaactcgagctggctttggctcaagcaaaatgcttccagttaattgccg

SEQ ID NO: 369161 - DNA, 477 bp, Homo sapiens
  misc_feature (6)..(6): n is a, c, g, or t
ctctangtatccccgatgaagatgccgttttcgttccgcctgggagggattctgagtagctgagattacaggcgtgtgccaccacacctagctaatttttctatttcttttttttgtagagatggggtttcatcatgttgcccaggctggtctcaaactcctggcctccagcagtccatccgccttggcctcccaaactgctgtgattacaggtgtgagctaccatgcctagccgaacattcttttgactcaaatgactccagttgctttagagatgggctggcataattctagaatccctgtatcatggtttcagcttcttaggatcattttttacatttgaatgagaggaaaaaagtccaaagatgtcttcaattattattaacatttttgggaaacctttcttactcttgtgttatgtgtaccactctcaagtatgctgagctcgaaaaccaggcattgtattttctgttacct

SEQ ID NO: 369162 - DNA, 2007 bp, Homo sapiens
ggcacgaggccgggttgtggacgccaggagtttgccaaacacagcaaacactggtgtgtgagcggctgaaggggactctttccactccgatctccctccctcccagcctgttttgatttactaggacttcctcctccgggcgaggcgggggaaggacgccgccgagcgcctggagttgtgcgcgtgtgcgtgtgcgcgtgtgcgagtgtgaagtgcagcgctggagtgcaacatgctgtaatgggaggaaacccagcggcgtcggagcgcccgggaccgccgcggccgttctgagcgcagtggcgccgagcagcccctcccgcagccggtgtgacctgtcccttcaggctccaaccaggaatggagacgccattggatgttttgtccagggcagcatctctggtgcatgctgatgacgaaaaaccgtcacctgggaacttgttagaaatgcagaatcgtagtcctcgctgcggaactgatgactgagaatacgcattttgacaaaatccctgagtcctgtgcactcaaaagttggagacatccaggtctgcaccatggcgaagctgctctcaggggagaacccagaatgcagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaatcatgggggtggggtggggggaagggaagggatggtttatttgcaaaaaccatgttgttgggatttgtgttctgtttttgtacttgcttggtatccgtacaagggggccctcaaacatgatagcaggaactacgcgtggaacatctgtctaatgtagcatccttacttcctgcctcagttaccaaagaaacctctgatgcaggtctgctgccccgacggggccaggactccacagcgctttctcagtcacaagccatgatgaattggtgactcagacgctttgtgctttttcctttgcttcttgagaccggggtgtgtgtggctcagcttccacggcgtgtttggttcggtccatgtgtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacgacacgtggatctgcatggtttgcgtgagctttgaacagtccccactt

SEQ ID NO: 369163 - DNA, 3719 bp, Homo sapiens
ggcacgaggccgggttgtggacgccaggagtttgccaaacacagcaaacactggtgtgtgagcggctgaaggggactctttccactccgatctccctccctcccagcctgttttgatttactaggacttcctcctccgggcgaggcgggggaaggacgccgccgagcgcctggagttgtgcgcgtgtgcgtgtgcgcgtgtgcgagtgtgaagtgcagcgctggagtgcaacatgctgtaatgggaggaaacccagcggcgtcggagcgcccgggaccgccgcggccgttctgagcgcagtggcgccgagcagcccctcccgcagccggtgtgacctgtcccttcaggctccaaccaggaatggagacgccattggatgttttgtccagggcagcatctctggtgcatgctgatgacgaaaaacgcgaagctgctctcaggggagaacccagaatgcagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaatcatgggggtggggtggggggaagggaagggatggtttatttgcaaaaaccatgttgttgggatttgtgttctgtttttgtacttgcttggtatccgtacaagggggccctcaaacatgatagcaggaactacgcgtggaacatctgtctaatgtagcatccttacttcctgcctcagttaccaaagaaacctctgatgcaggtctgctgccccgacggggccaggactccacagcgctttctcagtcacaagccatgatgaattggtgactcagacgctttgtgctttttcctttgcttcttgagaccggggtgtgtgtggctcagcttccacggcgtgtttggttcggtccatgtgtgtgcgtgtgtatacttgaagagaactgtcgtgtctgatttgcactattggaggaggactaaagttgcctgacaactttatgtgttatgccagaactctgagggcaaactgctgaaaaacaaagggtttaaggatgacatttctgaccatttgtgtgtttgttgttgttactgtttttgttttttttaatgtagacaatacagctttggaaggggaagtctcatacaggttataggtctttctctctctagatttcaggtgcttgcaactggactgcagactctaccaatcacgggcattttatcttctctgaacactgcagtttgttagactagagctgaggttggaggattccatagtgctttaaacgtgatgcatgttttaatggagaaaaaatagctggtttctattaattatatagacagtaaacaaaaaccttaatacttactatcttcttttcagaattagtttatttttgtcagttacagtcctagatatacttactgctggtacagttgtactctaagattggtatttgatattcactttactcacaagtagtgcgggaggccagctcctggcaggccctcgcgatgagcagtgggtcagctgcggtgtgggatgctggagtttggctgcaggctgacatcatttatttttgcatccctgtctgctttgttacaagctcccaggggaggtggggtttgtgtcttccaacttccctacatgcagaaactgctccctttgaactctcttggctgaacagcagattactgacagacaatctgtgatatggtgttttatacgcttcctcgtacgctggggccaaggcagtatacattcctctgactttatactgttattactgcatttattatttgctatattaatagctactaactagaaattagatgaagcaagcatgacagacacagctgtggaggtcacagctgctcctttttggtcaatgagcgtttctatcccctccccctggggtgtgctgtgtcccacctggcccaccagaggctcacgacgatggcacctgaccaggtgacgtgggcgtggtcacctcacctgcaaggctttgtggactctgcacaccgtatgacccccggttttacagtttttagctgttgaattttggaaattggcactgggtgaaaaggtcggaggactggctcttgtagtcacagagtggctgcaggcctttgaaaagtggaggaaagaaaagcccttctccttgccccgcacacatttcactcccactgtactgggcttccaagctttggcattcaggcccctatattttctgtaggaaaaatcgttgagaacacttttctatatgggtgattttgagaccatcgttacgctgtgcgtaaagaatgtacagagaaatttgtaggtattttttgaagaacattaatttgttaatgatatgtagctatttaatttttccctttcctattgtaatcattcattttttttgttgttcggaaaaaaaaagttgatctttttttttgtcgtagatttgtctgtaaaagtgcaggaacagttattctatgagaacactgcatctgcattcatagccacgagtttgttattgctacaggctactgagcgtcgtaacaggaaaaccacccacagctgaccggctcggtggaggacactcctgggacaggtctctttgtcagtgaacaagggcgtcactctgggaggggtcggcggtgctggcggccgggtccctggtgcactgacctatctgggataggcagtaccctggaggggggcctggggcagaggaggcagcagaaaaccaaacatttcactgagaaagccccctccctgctctaagaaggggctccgtgaagttcttcccagagccgcgctgcctgcagtgcgctctgaccttctcttcatgtgtgtaaatctgtaatataccattctctgtggcctgtttttcctggaagaagaaaaaaaaaggtttggcaggccatctttttttgtacttaaaagtagccttaagaacaataataaagtgctcttaaacc

SEQ ID NO: 369164 - DNA, 3579 bp, Homo sapiens
tcccgcgctcccgtccgccggcccggtccgcgcgtgcgtgtgcgtgtgcgtgtttggcgggggcccgtgcgggggctcgggcgcgagcccgcctgtgcgtctgcgcgccctcggggtgcgccccgcgtgcccaggtcccgtccccgcccctgggtcccccgcagggccaggccggccccaggcgggcgcgcccagagccgccgggcggctccaaccaggaatggagacgccattggatgttttgtccagggcagcatctctggtgcatgctgatgacgaaaaacgcgaagctgctctcaggggagaacccagaatgcagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaatcatgggggtggggtggggggaagggaagggatggtttatttgcaaaaaccatgttgttgggatttgtgttctgtttttgtacttgcttggtatccgtacaagggggccctcaaacatgatagcaggaactacgcgtggaacatctgtctaatgtagcatccttacttcctgcctcagttaccaaagaaacctctgatgcaggtctgctgccccgacggggccaggactccacagcgctttctcagtcacaagccatgatgaattggtgactcagacgctttgtgctttttcctttgcttcttgagaccggggtgtgtgtggctcagcttccacggcgtgtttggttcggtccatgtgtgtgcgtgtgtatacttgaagagaactgtcgtgtctgatttgcactattggaggaggactaaagttgcctgacaactttatgtgttatgccagaactctgagggcaaactgctgaaaaacaaagggtttaaggatgacatttctgaccatttgtgtgtttgttgttgttactgtttttgttttttttaatgtagacaatacagctttggaaggggaagtctcatacaggttataggtctttctctctctagatttcaggtgcttgcaactggactgcagactctaccaatcacgggcattttatcttctctgaacactgcagtttgttagactagagctgaggttggaggattccatagtgctttaaacgtgatgcatgttttaatggagaaaaaatagctggtttctattaattatatagacagtaaacaaaaaccttaatacttactatcttcttttcagaattagtttatttttgtcagttacagtcctagatatacttactgctggtacagttgtactctaagattggtatttgatattcactttactcacaagtagtgcgggaggccagctcctggcaggccctcgcgatgagcagtgggtcagctgcggtgtgggatgctggagtttggctgcaggctgacatcatttatttttgcatccctgtctgctttgttacaagctcccaggggaggtggggtttgtgtcttccaacttccctacatgcagaaactgctccctttgaactctcttggctgaacagcagattactgacagacaatctgtgatatggtgttttatacgcttcctcgtacgctggggccaaggcagtatacattcctctgactttatactgttattactgcatttattatttgctatattaatagctactaactagaaattagatgaagcaagcatgacagacacagctgtggaggtcacagctgctcctttttggtcaatgagcgtttctatcccctccccctggggtgtgctgtgtcccacctggcccaccagaggctcacgacgatggcacctgaccaggtgacgtgggcgtggtcacctcacctgcaaggctttgtggactctgcacaccgtatgacccccggttttacagtttttagctgttgaattttggaaattggcactgggtgaaaaggtcggaggactggctcttgtagtcacagagtggctgcaggcctttgaaaagtggaggaaagaaaagcccttctccttgccccgcacacatttcactcccactgtactgggcttccaagctttggcattcaggcccctatattttctgtaggaaaaatcgttgagaacacttttctatatgggtgattttgagaccatcgttacgctgtgcgtaaagaatgtacagagaaatttgtaggtattttttgaagaacattaatttgttaatgatatgtagctatttaatttttccctttcctattgtaatcattcattttttttgttgttcggaaaaaaaaagttgatctttttttttgtcgtagatttgtctgtaaaagtgcaggaacagttattctatgagaacactgcatctgcattcatagccacgagtttgttattgctacaggctactgagcgtcgtaacaggaaaaccacccacagctgaccggctcggtggaggacactcctgggacaggtctctttgtcagtgaacaagggcgtcactctgggaggggtcggcggtgctggcggccgggtccctggtgcactgacctatctgggataggcagtaccctggaggggggcctggggcagaggaggcagcagaaaaccaaacatttcactgagaaagccccctccctgctctaagaaggggctccgtgaagttcttcccagagccgcgctgcctgcagtgcgctctgaccttctcttcatgtgtgtaaatctgtaatataccattctctgtggcctgtttttcctggaagaagaaaaaaaaaggtttggcaggccatctttttttgtacttaaaagtagccttaagaacaataataaagtgctcttaaacc

SEQ ID NO: 369165 - DNA, 3831 bp, Homo sapiens
tcccgcgctcccgtccgccggcccggtccgcgcgtgcgtgtgcgtgtgcgtgtttggcgggggcccgtgcgggggctcgggcgcgagcccgcctgtgcgtctgcgcgccctcggggtgcgccccgcgtgcccaggtcccgtccccgcccctgggtcccccgcagggccaggccggccccaggcgggcgcgcccagagccgccgggcggctccaaccaggaatggagacgccattggatgttttgtccagggcagcatctctggtgcatgctgatgacgaaaaacggtcttgctctgttgcccagactggagtatagtggcacaatcttggctcactgcaagctccgccccctggggctcaagtgatcctcccacctcagcctctcgagtagctgggaccacagcgtcacctgggaacttgttagaaatgcagaatcgtagtcctcgctgcggaactgatgactgagaatacgcattttgacaaaatccctgagtcctgtgcactcaaaagttggagacatccaggtctgcaccatggcgaagctgctctcaggggagaacccagaatgcagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaatcatgggggtggggtggggggaagggaagggatggtttatttgcaaaaaccatgttgttgggatttgtgttctgtttttgtacttgcttggtatccgtacaagggggccctcaaacatgatagcaggaactacgcgtggaacatctgtctaatgtagcatccttacttcctgcctcagttaccaaagaaacctctgatgcaggtctgctgccccgacggggccaggactccacagcgctttctcagtcacaagccatgatgaattggtgactcagacgctttgtgctttttcctttgcttcttgagaccggggtgtgtgtggctcagcttccacggcgtgtttggttcggtccatgtgtgtgcgtgtgtatacttgaagagaactgtcgtgtctgatttgcactattggaggaggactaaagttgcctgacaactttatgtgttatgccagaactctgagggcaaactgctgaaaaacaaagggtttaaggatgacatttctgaccatttgtgtgtttgttgttgttactgtttttgttttttttaatgtagacaatacagctttggaaggggaagtctcatacaggttataggtctttctctctctagatttcaggtgcttgcaactggactgcagactctaccaatcacgggcattttatcttctctgaacactgcagtttgttagactagagctgaggttggaggattccatagtgctttaaacgtgatgcatgttttaatggagaaaaaatagctggtttctattaattatatagacagtaaacaaaaaccttaatacttactatcttcttttcagaattagtttatttttgtcagttacagtcctagatatacttactgctggtacagttgtactctaagattggtatttgatattcactttactcacaagtagtgcgggaggccagctcctggcaggccctcgcgatgagcagtgggtcagctgcggtgtgggatgctggagtttggctgcaggctgacatcatttatttttgcatccctgtctgctttgttacaagctcccaggggaggtggggtttgtgtcttccaacttccctacatgcagaaactgctccctttgaactctcttggctgaacagcagattactgacagacaatctgtgatatggtgttttatacgcttcctcgtacgctggggccaaggcagtatacattcctctgactttatactgttattactgcatttattatttgctatattaatagctactaactagaaattagatgaagcaagcatgacagacacagctgtggaggtcacagctgctcctttttggtcaatgagcgtttctatcccctccccctggggtgtgctgtgtcccacctggcccaccagaggctcacgacgatggcacctgaccaggtgacgtgggcgtggtcacctcacctgcaaggctttgtggactctgcacaccgtatgacccccggttttacagtttttagctgttgaattttggaaattggcactgggtgaaaaggtcggaggactggctcttgtagtcacagagtggctgcaggcctttgaaaagtggaggaaagaaaagcccttctccttgccccgcacacatttcactcccactgtactgggcttccaagctttggcattcaggcccctatattttctgtaggaaaaatcgttgagaacacttttctatatgggtgattttgagaccatcgttacgctgtgcgtaaagaatgtacagagaaatttgtaggtattttttgaagaacattaatttgttaatgatatgtagctatttaatttttccctttcctattgtaatcattcattttttttgttgttcggaaaaaaaaagttgatctttttttttgtcgtagatttgtctgtaaaagtgcaggaacagttattctatgagaacactgcatctgcattcatagccacgagtttgttattgctacaggctactgagcgtcgtaacaggaaaaccacccacagctgaccggctcggtggaggacactcctgggacaggtctctttgtcagtgaacaagggcgtcactctgggaggggtcggcggtgctggcggccgggtccctggtgcactgacctatctgggataggcagtaccctggaggggggcctggggcagaggaggcagcagaaaaccaaacatttcactgagaaagccccctccctgctctaagaaggggctccgtgaagttcttcccagagccgcgctgcctgcagtgcgctctgaccttctcttcatgtgtgtaaatctgtaatataccattctctgtggcctgtttttcctggaagaagaaaaaaaaaggtttggcaggccatctttttttgtacttaaaagtagccttaagaacaataataaagtgctcttaaacc

SEQ ID NO: 369166 - DNA, 3164 bp, Homo sapiens
gctttcttgtgggaggacgctgggctgtcttcatgctctttggcaatgattaaagtgaggaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaatcatgggggtggggtggggggaagggaagggatggtttatttgcaaaaaccatgttgttgggatttgtgttctgtttttgtacttgcttggtatccgtacaagggggccctcaaacatgatagcaggaactacgcgtggaacatctgtctaatgtagcatccttacttcctgcctcagttaccaaagaaacctctgatgcaggtctgctgccccgacggggccaggactccacagcgctttctcagtcacaagccatgatgaattggtgactcagacgctttgtgctttttcctttgcttcttgagaccggggtgtgtgtggctcagcttccacggcgtgtttggttcggtccatgtgtgtgcgtgtgtatacttgaagagaactgtcgtgtctgatttgcactattggaggaggactaaagttgcctgacaactttatgtgttatgccagaactctgagggcaaactgctgaaaaacaaagggtttaaggatgacatttctgaccatttgtgtgtttgttgttgttactgtttttgttttttttaatgtagacaatacagctttggaaggggaagtctcatacaggttataggtctttctctctctagatttcaggtgcttgcaactggactgcagactctaccaatcacgggcattttatcttctctgaacactgcagtttgttagactagagctgaggttggaggattccatagtgctttaaacgtgatgcatgttttaatggagaaaaaatagctggtttctattaattatatagacagtaaacaaaaaccttaatacttactatcttcttttcagaattagtttatttttgtcagttacagtcctagatatacttactgctggtacagttgtactctaagattggtatttgatattcactttactcacaagtagtgcgggaggccagctcctggcaggccctcgcgatgagcagtgggtcagctgcggtgtgggatgctggagtttggctgcaggctgacatcatttatttttgcatccctgtctgctttgttacaagctcccaggggaggtggggtttgtgtcttccaacttccctacatgcagaaactgctccctttgaactctcttggctgaacagcagattactgacagacaatctgtgatatggtgttttatacgcttcctcgtacgctggggccaaggcagtatacattcctctgactttatactgttattactgcatttattatttgctatattaatagctactaactagaaattagatgaagcaagcatgacagacacagctgtggaggtcacagctgctcctttttggtcaatgagcgtttctatcccctccccctggggtgtgctgtgtcccacctggcccaccagaggctcacgacgatggcacctgaccaggtgacgtgggcgtggtcacctcacctgcaaggctttgtggactctgcacaccgtatgacccccggttttacagtttttagctgttgaattttggaaattggcactgggtgaaaaggtcggaggactggctcttgtagtcacagagtggctgcaggcctttgaaaagtggaggaaagaaaagcccttctccttgccccgcacacatttcactcccactgtactgggcttccaagctttggcattcaggcccctatattttctgtaggaaaaatcgttgagaacacttttctatatgggtgattttgagaccatcgttacgctgtgcgtaaagaatgtacagagaaatttgtaggtattttttgaagaacattaatttgttaatgatatgtagctatttaatttttccctttcctattgtaatcattcattttttttgttgttcggaaaaaaaaagttgatctttttttttgtcgtagatttgtctgtaaaagtgcaggaacagttattctatgagaacactgcatctgcattcatagccacgagtttgttattgctacaggctactgagcgtcgtaacaggaaaaccacccacagctgaccggctcggtggaggacactcctgggacaggtctctttgtcagtgaacaagggcgtcactctgggaggggtcggcggtgctggcggccgggtccctggtgcactgacctatctgggataggcagtaccctggaggggggcctggggcagaggaggcagcagaaaaccaaacatttcactgagaaagccccctccctgctctaagaaggggctccgtgaagttcttcccagagccgcgctgcctgcagtgcgctctgaccttctcttcatgtgtgtaaatctgtaatataccattctctgtggcctgtttttcctggaagaagaaaaaaaaaggtttggcaggccatctttttttgtacttaaaagtagccttaagaacaataataaagtgctcttaaacc

SEQ ID NO: 369167 - DNA, 3759 bp, Homo sapiens
ggcacgaggccgggttgtggacgccaggagtttgccaaacacagcaaacactggtgtgtgagcggctgaaggggactctttccactccgatctccctccctcccagcctgttttgatttactaggacttcctcctccgggcgaggcgggggaaggacgccgccgagcgcctggagttgtgcgcgtgtgcgtgtgcgcgtgtgcgagtgtgaagtgcagcgctggagtgcaacatgctgtaatgggaggaaacccagcggcgtcggagcgcccgggaccgccgcggccgttctgagcgcagtggcgccgagcagcccctcccgcagccggtgtgacctgtcccttcaggctccaaccaggaatggagacgccattggatgttttgtccagggcagcatctctggtgcatgctgatgacgaaaaacgcgaagctgctctcaggggagaacccagaatgcagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgccacctgtgtctgactgcctgccttcctgcttgcctgcagctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaatcatgggggtggggtggggggaagggaagggatggtttatttgcaaaaaccatgttgttgggatttgtgttctgtttttgtacttgcttggtatccgtacaagggggccctcaaacatgatagcaggaactacgcgtggaacatctgtctaatgtagcatccttacttcctgcctcagttaccaaagaaacctctgatgcaggtctgctgccccgacggggccaggactccacagcgctttctcagtcacaagccatgatgaattggtgactcagacgctttgtgctttttcctttgcttcttgagaccggggtgtgtgtggctcagcttccacggcgtgtttggttcggtccatgtgtgtgcgtgtgtatacttgaagagaactgtcgtgtctgatttgcactattggaggaggactaaagttgcctgacaactttatgtgttatgccagaactctgagggcaaactgctgaaaaacaaagggtttaaggatgacatttctgaccatttgtgtgtttgttgttgttactgtttttgttttttttaatgtagacaatacagctttggaaggggaagtctcatacaggttataggtctttctctctctagatttcaggtgcttgcaactggactgcagactctaccaatcacgggcattttatcttctctgaacactgcagtttgttagactagagctgaggttggaggattccatagtgctttaaacgtgatgcatgttttaatggagaaaaaatagctggtttctattaattatatagacagtaaacaaaaaccttaatacttactatcttcttttcagaattagtttatttttgtcagttacagtcctagatatacttactgctggtacagttgtactctaagattggtatttgatattcactttactcacaagtagtgcgggaggccagctcctggcaggccctcgcgatgagcagtgggtcagctgcggtgtgggatgctggagtttggctgcaggctgacatcatttatttttgcatccctgtctgctttgttacaagctcccaggggaggtggggtttgtgtcttccaacttccctacatgcagaaactgctccctttgaactctcttggctgaacagcagattactgacagacaatctgtgatatggtgttttatacgcttcctcgtacgctggggccaaggcagtatacattcctctgactttatactgttattactgcatttattatttgctatattaatagctactaactagaaattagatgaagcaagcatgacagacacagctgtggaggtcacagctgctcctttttggtcaatgagcgtttctatcccctccccctggggtgtgctgtgtcccacctggcccaccagaggctcacgacgatggcacctgaccaggtgacgtgggcgtggtcacctcacctgcaaggctttgtggactctgcacaccgtatgacccccggttttacagtttttagctgttgaattttggaaattggcactgggtgaaaaggtcggaggactggctcttgtagtcacagagtggctgcaggcctttgaaaagtggaggaaagaaaagcccttctccttgccccgcacacatttcactcccactgtactgggcttccaagctttggcattcaggcccctatattttctgtaggaaaaatcgttgagaacacttttctatatgggtgattttgagaccatcgttacgctgtgcgtaaagaatgtacagagaaatttgtaggtattttttgaagaacattaatttgttaatgatatgtagctatttaatttttccctttcctattgtaatcattcattttttttgttgttcggaaaaaaaaagttgatctttttttttgtcgtagatttgtctgtaaaagtgcaggaacagttattctatgagaacactgcatctgcattcatagccacgagtttgttattgctacaggctactgagcgtcgtaacaggaaaaccacccacagctgaccggctcggtggaggacactcctgggacaggtctctttgtcagtgaacaagggcgtcactctgggaggggtcggcggtgctggcggccgggtccctggtgcactgacctatctgggataggcagtaccctggaggggggcctggggcagaggaggcagcagaaaaccaaacatttcactgagaaagccccctccctgctctaagaaggggctccgtgaagttcttcccagagccgcgctgcctgcagtgcgctctgaccttctcttcatgtgtgtaaatctgtaatataccattctctgtggcctgtttttcctggaagaagaaaaaaaaaggtttggcaggccatctttttttgtacttaaaagtagccttaagaacaataataaagtgctcttaaacc

SEQ ID NO: 369168 - DNA, 3449 bp, Homo sapiens
ggcacgaggccgggttgtggacgccaggagtttgccaaacacagcaaacactggtgtgtgagcggctgaaggggactctttccactccgatctccctccctcccagcctgttttgatttactaggacttcctcctccgggcgaggcgggggaaggacgccgccgagcgcctggagttgtgcgcgtgtgcgtgtgcgcgtgtgcgagtgtgaagtgcagcgctggagtgcaacatgctgtaatgggaggaaacccagcggcgtcggagcgcccgggaccgccgcggccgttctgagcgcagtggcgccgagcagcccctcccgcagccggtgtgacctgtcccttcaggctccaaccaggaatggagacgccattggatgttttgtccagggcagcatctctggtgcatgctgatgacgaaaaacgcgaagctgctctcaggggagaacccagaatgcagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcagggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaatcatgggggtggggtggggggaagggaagggatggtttatttgcaaaaaccatgttgttgggatttgtgttctgtttttgtacttgcttggtatccgtacaagggggccctcaaacatgatagcaggaactacgcgtggaacatctgtctaatgtagcatccttacttcctgcctcagttaccaaagaaacctctgatgcaggtctgctgccccgacggggccaggactccacagcgctttctcagtcacaagccatgatgaattggtgactcagacgctttgtgctttttcctttgcttcttgagaccggggtgtgtgtggctcagcttccacggcgtgtttggttcggtccatgtgtgtgcgtgtgtatacttgaagagaactgtcgtgtctgatttgcactattggaggaggactaaagttgcctgacaactttatgtgttatgccagaactctgagggcaaactgctgaaaaacaaagggtttaaggatgacatttctgaccatttgtgtgtttgttgttgttactgtttttgttttttttaatgtagacaatacagctttggaaggggaagtctcatacaggttataggtctttctctctctagatttcaggtgcttgcaactggactgcagactctaccaatcacgggcattttatcttctctgaacactgcagtttgttagactagagctgaggttggaggattccatagtgctttaaacgtgatgcatgttttaatggagaaaaaatagctggtttctattaattatatagacagtaaacaaaaaccttaatacttactatcttcttttcagaattagtttatttttgtcagttacagtcctagatatacttactgctggtacagttgtactctaagattggtatttgatattcactttactcacaagtagtgcgggaggccagctcctggcaggccctcgcgatgagcagtgggtcagctgcggtgtgggatgctggagtttggctgcaggctgacatcatttatttttgcatccctgtctgctttgttacaagctcccaggggaggtggggtttgtgtcttccaacttccctacatgcagaaactgctccctttgaactctcttggctgaacagcagattactgacagacaatctgtgatatggtgttttatacgcttcctcgtacgctggggccaaggcagtatacattcctctgactttatactgttattactgcatttattatttgctatattaatagctactaactagaaattagatgaagcaagcatgacagacacagctgtggaggtcacagctgctcctttttggtcaatgagcgtttctatcccctccccctggggtgtgctgtgtcccacctggcccaccagaggctcacgacgatggcacctgaccaggtgacgtgggcgtggtcacctcacctgcaaggctttgtggactctgcacaccgtatgacccccggttttacagtttttagctgttgaattttggaaattggcactgggtgaaaaggtcggaggactggctcttgtagtcacagagtggctgcaggcctttgaaaagtggaggaaagaaaagcccttctccttgccccgcacacatttcactcccactgtactgggcttccaagctttggcattcaggcccctatattttctgtaggaaaaatcgttgagaacacttttctatatgggtgattttgagaccatcgttacgctgtgcgtaaagaatgtacagagaaatttgtaggtattttttgaagaacattaatttgttaatgatatgtagctatttaatttttccctttcctattgtaatcattcattttttttgttgttcggaaaaaaaaagttgatctttttttttgtcgtagatttgtctgtaaaagtgcaggaacagttattctatgagaacactgcatctgcattcatagccacgagtttgttattgctacaggctactgagcgtcgtaacaggaaaaccacccacagctgaccggctcggtggaggacactcctgggacaggtctctttgtcagtgaacaagggcgtcactctgggaggggtcggcggtgctggcggccgggtccctggtgcactgacctatctgggataggcagtaccctggaggggggcctggggcagaggaggcagcagaaaaccaaacatttcactgagaaagccccctccctgctctaagaaggggctccgtgaagttcttcccagagccgcgctgcctgcagtgcgctctgaccttctcttcatgtgtgtaaatctgtaatataccattctctgtggcctgtttttcctggaagaagaaaaaaaaaggtttggcaggccatctttttttgtacttaaaagtagccttaagaacaataataaagtgctcttaaacc

SEQ ID NO: 369169 - DNA, 815 bp, Homo sapiens
cagttacctatgggggcaaaagctaaaaggggtaatagagatagcaataagggagccaaagctgtgaggaaagtccttggcagagagatgagaaagaactagattggggaggacgcacaaagaaacagagcgaaagggaaactgagaagctgtgcagtcgatgggtgcccacctggactggatttaagtcagaagagaaggaagatgtgagtattcattaaacgtctctgcgaagcctgtaaccccacaccggctcttcgaagaagcattatctctgttttacggatgagaaaactgaggacttcctcctccgggcgaggcgggggaaggacgccgccgagcgcctggagttgtgcgcgtgtgcgtgtgcgcgtgtgcgagtgtgaagtgcagcgctggagtgcaacatgctgtaatgggaggaaacccagcggcgtcggagcgcccgggaccgccgcggccgttctgagcgcagtggcgccgagcagcccctcccgcagccggtgtgacctgtcccttcaggctccaaccaggaatggagacgccattggatgttttgtccagggcagcatctctggtgcatgctgatgacgaaaaacagataacatcttaagggacactgaagcttgtgcgtgtgtgccttggaagtggccgttgtggacccagagatcatcctttctgatctgacaccttcttcactgccctggcccagtgtcttttctgcaaggctggaagcccccttagactggtcatgtcccatctctttccggagggaagatgatcccaaagacgacttttctctccacggtgctacc

SEQ ID NO: 369170 - DNA, 957 bp, Homo sapiens
cagttacctatgggggcaaaagctaaaaggggtaatagagatagcaataagggagccaaagctgtgaggaaagtccttggcagagagatgagaaagaactagattggggaggacgcacaaagaaacagagcgaaagggaaactgagaagctgtgcagtcgatgggtgcccacctggactggatttaagtcagaagagaaggaagatgtgagtattcattaaacgtctctgcgaagcctgtaaccccacaccggctcttcgaagaagcattatctctgttttacggatgagaaaactgaggacttcctcctccgggcgaggcgggggaaggacgccgccgagcgcctggagttgtgcgcgtgtgcgtgtgcgcgtgtgcgagtgtgaagtgcagcgctggagtgcaacatgctgtaatgggaggaaacccagcggcgtcggagcgcccgggaccgccgcggccgttctgagcgcagtggcgccgagcagcccctcccgcagccggtgtgacctgtcccttcaggctccaaccaggaatggagacgccattggatgttttgtccagggcagcatctctggtgcatgctgatgacgaaaaacagatggggtttcatcatgttgcccaggctggtctcaaactcctggcctccagcagtccatccgccttggcctcccaaactgctgtgattacaggtgtgagctaccatgcctagccgaacattcttttgactcaaatgactccagttgctttagagatgggctggcataattctagaatccctgtatcatggtttcagcttcttaggatcattttttacatttgaatgagaggaaaaaagtccaaagatgtcttcaattattattaacatttttgggaaacctttcttactcttgtgttatgtgtaccactctcaagtatgctgagctcgaaaaccaggcattgtattttctgttacct

SEQ ID NO: 369171 - DNA, 489 bp, Homo sapiens
atttcctccatttcctctctgtcccgatttgtaggtcatcactgaggccaactcgagctggctttggctcaagcaaaatgcttccagttaattgccgtgtattgaagtgtcctggatggctccaggcacacccgcggctcagtggacatgatgggaagggctctggggacgttaacgggagaatcgaggtccctcctgcaaccctctgtcctccacaggatgcccggtgtttgtcttaacagatttgagagatggggacagaccaactcaacagttgagcttttgtcctttgtaccctcactgatccaaacagccacgaccaagggccactacacacacccttggagctgcgctcactctgtggattggctgtgtttagcaacaggactccagtattgaagtgggaggtggcagactgggtcaggaagggcaccaggacagagcctgaagggtgctggggagggccccaggggtggtgcccggtactga

SEQ ID NO: 369172 - DNA, 818 bp, Homo sapiens
agaggaaatcgcgtgctgtaattctgacagcaaatctattttctcaccaaatggaactgtaatgatgcgtgtagcgttttggcaaggcaccctctataaataaaccctcccaggagttcctgacctaccccaggacccataggaaacttttattgcagtgcagggggcaagcaggccccttacctcgcaaccctcctttcagggaggacttttattctgacaagcgcccgcccatccagttttgtgcctgagactgcttgccaagtttgtgaggcccaaggctttcttgtgggaggacgctgggctgtcttcatgctctttggcaatgattaaagtgaggttagtaccaagaaccctttcattttattcccttatccttgctttttcaaaccagatggcaaccctgtattttcagctgtaattaatttaaactgcgagacagcaagtgctgggagaggtagagtagtctttgcttagaagggacagcagtgattttccttctcgtccctcccttctccccaaacgccaccttgtcccaatcagatttgtgccatgcacagtttctcctaagcggggactggaatgggagagagggctgctgagagcagctgcagcatggctgcctgcagtagctggaagggttaaggcacactagtgattgtttccttcatggattggaagtaaccaagtttcaggtgatggctgtcatgtgaccgcctctagacaatggtgcatagtttggctgctgattcggggagtacaaggtgctttttcttcccactcagtccagctgccaagatcgcctccaaaagggggta

SEQ ID NO: 369173 - DNA, 3787 bp, Homo sapiens
gtcatgccaagcatagccctcatgtcagcgctgccggcttgcagcgggctgtgagaggggccggcgccgctttgtcctaggaaacgggctgcgcgtttctctttttcactcttttccatttccaggaaggacttgtaaggacttctgaaacgctgttttcatactcgatcggggatacagtacatacaccgtctaccagtaagcccttgaagggtttcgtgtgagctcgatttttttgtgcctgattttttttttttttaacttttgcatactttgttttgatagtctgaggctgggcctctgcctttgtgaagttgaagagccaggagctactcagcaacaattgatttttgaaacttaactcttttggggcaaaagcaaagagctggttttctttgctagcccaataaatgctatttatgaagatggacctgttgaactatcagtacttggacaagatgaacaacaatatcggcattctgtgctacgaaggcgaagctgctctcaggggagaacccagaatgcagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaatcatgggggtggggtggggggaagggaagggatggtttatttgcaaaaaccatgttgttgggatttgtgttctgtttttgtacttgcttggtatccgtacaagggggccctcaaacatgatagcaggaactacgcgtggaacatctgtctaatgtagcatccttacttcctgcctcagttaccaaagaaacctctgatgcaggtctgctgccccgacggggccaggactccacagcgctttctcagtcacaagccatgatgaattggtgactcagacgctttgtgctttttcctttgcttcttgagaccggggtgtgtgtggctcagcttccacggcgtgtttggttcggtccatgtgtgtgcgtgtgtatacttgaagagaactgtcgtgtctgatttgcactattggaggaggactaaagttgcctgacaactttatgtgttatgccagaactctgagggcaaactgctgaaaaacaaagggtttaaggatgacatttctgaccatttgtgtgtttgttgttgttactgtttttgttttttttaatgtagacaatacagctttggaaggggaagtctcatacaggttataggtctttctctctctagatttcaggtgcttgcaactggactgcagactctaccaatcacgggcattttatcttctctgaacactgcagtttgttagactagagctgaggttggaggattccatagtgctttaaacgtgatgcatgttttaatggagaaaaaatagctggtttctattaattatatagacagtaaacaaaaaccttaatacttactatcttcttttcagaattagtttatttttgtcagttacagtcctagatatacttactgctggtacagttgtactctaagattggtatttgatattcactttactcacaagtagtgcgggaggccagctcctggcaggccctcgcgatgagcagtgggtcagctgcggtgtgggatgctggagtttggctgcaggctgacatcatttatttttgcatccctgtctgctttgttacaagctcccaggggaggtggggtttgtgtcttccaacttccctacatgcagaaactgctccctttgaactctcttggctgaacagcagattactgacagacaatctgtgatatggtgttttatacgcttcctcgtacgctggggccaaggcagtatacattcctctgactttatactgttattactgcatttattatttgctatattaatagctactaactagaaattagatgaagcaagcatgacagacacagctgtggaggtcacagctgctcctttttggtcaatgagcgtttctatcccctccccctggggtgtgctgtgtcccacctggcccaccagaggctcacgacgatggcacctgaccaggtgacgtgggcgtggtcacctcacctgcaaggctttgtggactctgcacaccgtatgacccccggttttacagtttttagctgttgaattttggaaattggcactgggtgaaaaggtcggaggactggctcttgtagtcacagagtggctgcaggcctttgaaaagtggaggaaagaaaagcccttctccttgccccgcacacatttcactcccactgtactgggcttccaagctttggcattcaggcccctatattttctgtaggaaaaatcgttgagaacacttttctatatgggtgattttgagaccatcgttacgctgtgcgtaaagaatgtacagagaaatttgtaggtattttttgaagaacattaatttgttaatgatatgtagctatttaatttttccctttcctattgtaatcattcattttttttgttgttcggaaaaaaaaagttgatctttttttttgtcgtagatttgtctgtaaaagtgcaggaacagttattctatgagaacactgcatctgcattcatagccacgagtttgttattgctacaggctactgagcgtcgtaacaggaaaaccacccacagctgaccggctcggtggaggacactcctgggacaggtctctttgtcagtgaacaagggcgtcactctgggaggggtcggcggtgctggcggccgggtccctggtgcactgacctatctgggataggcagtaccctggaggggggcctggggcagaggaggcagcagaaaaccaaacatttcactgagaaagccccctccctgctctaagaaggggctccgtgaagttcttcccagagccgcgctgcctgcagtgcgctctgaccttctcttcatgtgtgtaaatctgtaatataccattctctgtggcctgtttttcctggaagaagaaaaaaaaaggtttggcaggccatctttttttgtacttaaaagtagccttaagaacaataataaagtgctcttaaacc

SEQ ID NO: 369174 - DNA, 3852 bp, Homo sapiens
ggcacgaggccgggttgtggacgccaggagtttgccaaacacagcaaacactggtgtgtgagcggctgaaggggactctttccactccgatctccctccctcccagcctgttttgatttactaggacttcctcctccgggcgaggcgggggaaggacgccgccgagcgcctggagttgtgcgcgtgtgcgtgtgcgcgtgtgcgagtgtgaagtgcagcgctggagtgcaacatgctgtaatgggaggaaacccagcggcgtcggagcgcccgggaccgccgcggccgttctgagcgcagtggcgccgagcagcccctcccgcagccggtgtgacctgtcccttcaggctccaaccaggaatggagacgccattggatgttttgtccagggcagcatctctggtgcatgctgatgacgaaaaaccgtcacctgggaacttgttagaaatgcagaatcgtagtcctcgctgcggaactgatgactgagaatacgcattttgacaaaatccctgagtcctgtgcactcaaaagttggagacatccaggtctgcaccatggcgaagctgctctcaggggagaacccagaatgcagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaatcatgggggtggggtggggggaagggaagggatggtttatttgcaaaaaccatgttgttgggatttgtgttctgtttttgtacttgcttggtatccgtacaagggggccctcaaacatgatagcaggaactacgcgtggaacatctgtctaatgtagcatccttacttcctgcctcagttaccaaagaaacctctgatgcaggtctgctgccccgacggggccaggactccacagcgctttctcagtcacaagccatgatgaattggtgactcagacgctttgtgctttttcctttgcttcttgagaccggggtgtgtgtggctcagcttccacggcgtgtttggttcggtccatgtgtgtgcgtgtgtatacttgaagagaactgtcgtgtctgatttgcactattggaggaggactaaagttgcctgacaactttatgtgttatgccagaactctgagggcaaactgctgaaaaacaaagggtttaaggatgacatttctgaccatttgtgtgtttgttgttgttactgtttttgttttttttaatgtagacaatacagctttggaaggggaagtctcatacaggttataggtctttctctctctagatttcaggtgcttgcaactggactgcagactctaccaatcacgggcattttatcttctctgaacactgcagtttgttagactagagctgaggttggaggattccatagtgctttaaacgtgatgcatgttttaatggagaaaaaatagctggtttctattaattatatagacagtaaacaaaaaccttaatacttactatcttcttttcagaattagtttatttttgtcagttacagtcctagatatacttactgctggtacagttgtactctaagattggtatttgatattcactttactcacaagtagtgcgggaggccagctcctggcaggccctcgcgatgagcagtgggtcagctgcggtgtgggatgctggagtttggctgcaggctgacatcatttatttttgcatccctgtctgctttgttacaagctcccaggggaggtggggtttgtgtcttccaacttccctacatgcagaaactgctccctttgaactctcttggctgaacagcagattactgacagacaatctgtgatatggtgttttatacgcttcctcgtacgctggggccaaggcagtatacattcctctgactttatactgttattactgcatttattatttgctatattaatagctactaactagaaattagatgaagcaagcatgacagacacagctgtggaggtcacagctgctcctttttggtcaatgagcgtttctatcccctccccctggggtgtgctgtgtcccacctggcccaccagaggctcacgacgatggcacctgaccaggtgacgtgggcgtggtcacctcacctgcaaggctttgtggactctgcacaccgtatgacccccggttttacagtttttagctgttgaattttggaaattggcactgggtgaaaaggtcggaggactggctcttgtagtcacagagtggctgcaggcctttgaaaagtggaggaaagaaaagcccttctccttgccccgcacacatttcactcccactgtactgggcttccaagctttggcattcaggcccctatattttctgtaggaaaaatcgttgagaacacttttctatatgggtgattttgagaccatcgttacgctgtgcgtaaagaatgtacagagaaatttgtaggtattttttgaagaacattaatttgttaatgatatgtagctatttaatttttccctttcctattgtaatcattcattttttttgttgttcggaaaaaaaaagttgatctttttttttgtcgtagatttgtctgtaaaagtgcaggaacagttattctatgagaacactgcatctgcattcatagccacgagtttgttattgctacaggctactgagcgtcgtaacaggaaaaccacccacagctgaccggctcggtggaggacactcctgggacaggtctctttgtcagtgaacaagggcgtcactctgggaggggtcggcggtgctggcggccgggtccctggtgcactgacctatctgggataggcagtaccctggaggggggcctggggcagaggaggcagcagaaaaccaaacatttcactgagaaagccccctccctgctctaagaaggggctccgtgaagttcttcccagagccgcgctgcctgcagtgcgctctgaccttctcttcatgtgtgtaaatctgtaatataccattctctgtggcctgtttttcctggaagaagaaaaaaaaaggtttggcaggccatctttttttgtacttaaaagtagccttaagaacaataataaagtgctcttaaacc

SEQ ID NO: 369175 - DNA, 3894 bp, Homo sapiens
cagttacctatgggggcaaaagctaaaaggggtaatagagatagcaataagggagccaaagctgtgaggaaagtccttggcagagagatgagaaagaactagattggggaggacgcacaaagaaacagagcgaaagggaaactgagaagctgtgcagtcgatgggtgcccacctggactggatttaagtcagaagagaaggaagatgtgagtattcattaaacgtctctgcgaagcctgtaaccccacaccggctcttcgaagaagcattatctctgttttacggatgagaaaactgaggacttcctcctccgggcgaggcgggggaaggacgccgccgagcgcctggagttgtgcgcgtgtgcgtgtgcgcgtgtgcgagtgtgaagtgcagcgctggagtgcaacatgctgtaatgggaggaaacccagcggcgtcggagcgcccgggaccgccgcggccgttctgagcgcagtggcgccgagcagcccctcccgcagccggtgtgacctgtcccttcaggctccaaccaggaatggagacgccattggatgttttgtccagggcagcatctctggtgcatgctgatgacgaaaaacgcgaagctgctctcaggggagaacccagaatgcagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaatcatgggggtggggtggggggaagggaagggatggtttatttgcaaaaaccatgttgttgggatttgtgttctgtttttgtacttgcttggtatccgtacaagggggccctcaaacatgatagcaggaactacgcgtggaacatctgtctaatgtagcatccttacttcctgcctcagttaccaaagaaacctctgatgcaggtctgctgccccgacggggccaggactccacagcgctttctcagtcacaagccatgatgaattggtgactcagacgctttgtgctttttcctttgcttcttgagaccggggtgtgtgtggctcagcttccacggcgtgtttggttcggtccatgtgtgtgcgtgtgtatacttgaagagaactgtcgtgtctgatttgcactattggaggaggactaaagttgcctgacaactttatgtgttatgccagaactctgagggcaaactgctgaaaaacaaagggtttaaggatgacatttctgaccatttgtgtgtttgttgttgttactgtttttgttttttttaatgtagacaatacagctttggaaggggaagtctcatacaggttataggtctttctctctctagatttcaggtgcttgcaactggactgcagactctaccaatcacgggcattttatcttctctgaacactgcagtttgttagactagagctgaggttggaggattccatagtgctttaaacgtgatgcatgttttaatggagaaaaaatagctggtttctattaattatatagacagtaaacaaaaaccttaatacttactatcttcttttcagaattagtttatttttgtcagttacagtcctagatatacttactgctggtacagttgtactctaagattggtatttgatattcactttactcacaagtagtgcgggaggccagctcctggcaggccctcgcgatgagcagtgggtcagctgcggtgtgggatgctggagtttggctgcaggctgacatcatttatttttgcatccctgtctgctttgttacaagctcccaggggaggtggggtttgtgtcttccaacttccctacatgcagaaactgctccctttgaactctcttggctgaacagcagattactgacagacaatctgtgatatggtgttttatacgcttcctcgtacgctggggccaaggcagtatacattcctctgactttatactgttattactgcatttattatttgctatattaatagctactaactagaaattagatgaagcaagcatgacagacacagctgtggaggtcacagctgctcctttttggtcaatgagcgtttctatcccctccccctggggtgtgctgtgtcccacctggcccaccagaggctcacgacgatggcacctgaccaggtgacgtgggcgtggtcacctcacctgcaaggctttgtggactctgcacaccgtatgacccccggttttacagtttttagctgttgaattttggaaattggcactgggtgaaaaggtcggaggactggctcttgtagtcacagagtggctgcaggcctttgaaaagtggaggaaagaaaagcccttctccttgccccgcacacatttcactcccactgtactgggcttccaagctttggcattcaggcccctatattttctgtaggaaaaatcgttgagaacacttttctatatgggtgattttgagaccatcgttacgctgtgcgtaaagaatgtacagagaaatttgtaggtattttttgaagaacattaatttgttaatgatatgtagctatttaatttttccctttcctattgtaatcattcattttttttgttgttcggaaaaaaaaagttgatctttttttttgtcgtagatttgtctgtaaaagtgcaggaacagttattctatgagaacactgcatctgcattcatagccacgagtttgttattgctacaggctactgagcgtcgtaacaggaaaaccacccacagctgaccggctcggtggaggacactcctgggacaggtctctttgtcagtgaacaagggcgtcactctgggaggggtcggcggtgctggcggccgggtccctggtgcactgacctatctgggataggcagtaccctggaggggggcctggggcagaggaggcagcagaaaaccaaacatttcactgagaaagccccctccctgctctaagaaggggctccgtgaagttcttcccagagccgcgctgcctgcagtgcgctctgaccttctcttcatgtgtgtaaatctgtaatataccattctctgtggcctgtttttcctggaagaagaaaaaaaaaggtttggcaggccatctttttttgtacttaaaagtagccttaagaacaataataaagtgctcttaaacc

SEQ ID NO: 369176 - DNA, 3645 bp, Homo sapiens
tcccgcgctcccgtccgccggcccggtccgcgcgtgcgtgtgcgtgtgcgtgtttggcgggggcccgtgcgggggctcgggcgcgagcccgcctgtgcgtctgcgcgccctcggggtgcgccccgcgtgcccaggtcccgtccccgcccctgggtcccccgcagggccaggccggccccaggcgggcgcgcccagagccgccgggcggaacacctggcagtttgaatgtgattcctccgatgctcacccccctggcctccacatctagacaaggctccaaccaggaatggagacgccattggatgttttgtccagggcagcatctctggtgcatgctgatgacgaaaaacgcgaagctgctctcaggggagaacccagaatgcagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaatcatgggggtggggtggggggaagggaagggatggtttatttgcaaaaaccatgttgttgggatttgtgttctgtttttgtacttgcttggtatccgtacaagggggccctcaaacatgatagcaggaactacgcgtggaacatctgtctaatgtagcatccttacttcctgcctcagttaccaaagaaacctctgatgcaggtctgctgccccgacggggccaggactccacagcgctttctcagtcacaagccatgatgaattggtgactcagacgctttgtgctttttcctttgcttcttgagaccggggtgtgtgtggctcagcttccacggcgtgtttggttcggtccatgtgtgtgcgtgtgtatacttgaagagaactgtcgtgtctgatttgcactattggaggaggactaaagttgcctgacaactttatgtgttatgccagaactctgagggcaaactgctgaaaaacaaagggtttaaggatgacatttctgaccatttgtgtgtttgttgttgttactgtttttgttttttttaatgtagacaatacagctttggaaggggaagtctcatacaggttataggtctttctctctctagatttcaggtgcttgcaactggactgcagactctaccaatcacgggcattttatcttctctgaacactgcagtttgttagactagagctgaggttggaggattccatagtgctttaaacgtgatgcatgttttaatggagaaaaaatagctggtttctattaattatatagacagtaaacaaaaaccttaatacttactatcttcttttcagaattagtttatttttgtcagttacagtcctagatatacttactgctggtacagttgtactctaagattggtatttgatattcactttactcacaagtagtgcgggaggccagctcctggcaggccctcgcgatgagcagtgggtcagctgcggtgtgggatgctggagtttggctgcaggctgacatcatttatttttgcatccctgtctgctttgttacaagctcccaggggaggtggggtttgtgtcttccaacttccctacatgcagaaactgctccctttgaactctcttggctgaacagcagattactgacagacaatctgtgatatggtgttttatacgcttcctcgtacgctggggccaaggcagtatacattcctctgactttatactgttattactgcatttattatttgctatattaatagctactaactagaaattagatgaagcaagcatgacagacacagctgtggaggtcacagctgctcctttttggtcaatgagcgtttctatcccctccccctggggtgtgctgtgtcccacctggcccaccagaggctcacgacgatggcacctgaccaggtgacgtgggcgtggtcacctcacctgcaaggctttgtggactctgcacaccgtatgacccccggttttacagtttttagctgttgaattttggaaattggcactgggtgaaaaggtcggaggactggctcttgtagtcacagagtggctgcaggcctttgaaaagtggaggaaagaaaagcccttctccttgccccgcacacatttcactcccactgtactgggcttccaagctttggcattcaggcccctatattttctgtaggaaaaatcgttgagaacacttttctatatgggtgattttgagaccatcgttacgctgtgcgtaaagaatgtacagagaaatttgtaggtattttttgaagaacattaatttgttaatgatatgtagctatttaatttttccctttcctattgtaatcattcattttttttgttgttcggaaaaaaaaagttgatctttttttttgtcgtagatttgtctgtaaaagtgcaggaacagttattctatgagaacactgcatctgcattcatagccacgagtttgttattgctacaggctactgagcgtcgtaacaggaaaaccacccacagctgaccggctcggtggaggacactcctgggacaggtctctttgtcagtgaacaagggcgtcactctgggaggggtcggcggtgctggcggccgggtccctggtgcactgacctatctgggataggcagtaccctggaggggggcctggggcagaggaggcagcagaaaaccaaacatttcactgagaaagccccctccctgctctaagaaggggctccgtgaagttcttcccagagccgcgctgcctgcagtgcgctctgaccttctcttcatgtgtgtaaatctgtaatataccattctctgtggcctgtttttcctggaagaagaaaaaaaaaggtttggcaggccatctttttttgtacttaaaagtagccttaagaacaataataaagtgctcttaaacc

SEQ ID NO: 369177 - DNA, 3386 bp, Homo sapiens
tgaggctgcacagtcttaggatgaggcgttgtctgattgcagaggccatgggttcttgcctccagctaacctgttaactggaggatcttgggcgaagctgctctcaggggagaacccagaatgcagaccctgccggtggcctctgccctcagcagtcaccgcaccggccctcccccaatcagccccagcaagaggaagttcagcatggagccaggtgacgaggacctagactgtgacaacgaccacgtctccaaaatgagtcgcatcttcaacccccatctgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaatcatgggggtggggtggggggaagggaagggatggtttatttgcaaaaaccatgttgttgggatttgtgttctgtttttgtacttgcttggtatccgtacaagggggccctcaaacatgatagcaggaactacgcgtggaacatctgtctaatgtagcatccttacttcctgcctcagttaccaaagaaacctctgatgcaggtctgctgccccgacggggccaggactccacagcgctttctcagtcacaagccatgatgaattggtgactcagacgctttgtgctttttcctttgcttcttgagaccggggtgtgtgtggctcagcttccacggcgtgtttggttcggtccatgtgtgtgcgtgtgtatacttgaagagaactgtcgtgtctgatttgcactattggaggaggactaaagttgcctgacaactttatgtgttatgccagaactctgagggcaaactgctgaaaaacaaagggtttaaggatgacatttctgaccatttgtgtgtttgttgttgttactgtttttgttttttttaatgtagacaatacagctttggaaggggaagtctcatacaggttataggtctttctctctctagatttcaggtgcttgcaactggactgcagactctaccaatcacgggcattttatcttctctgaacactgcagtttgttagactagagctgaggttggaggattccatagtgctttaaacgtgatgcatgttttaatggagaaaaaatagctggtttctattaattatatagacagtaaacaaaaaccttaatacttactatcttcttttcagaattagtttatttttgtcagttacagtcctagatatacttactgctggtacagttgtactctaagattggtatttgatattcactttactcacaagtagtgcgggaggccagctcctggcaggccctcgcgatgagcagtgggtcagctgcggtgtgggatgctggagtttggctgcaggctgacatcatttatttttgcatccctgtctgctttgttacaagctcccaggggaggtggggtttgtgtcttccaacttccctacatgcagaaactgctccctttgaactctcttggctgaacagcagattactgacagacaatctgtgatatggtgttttatacgcttcctcgtacgctggggccaaggcagtatacattcctctgactttatactgttattactgcatttattatttgctatattaatagctactaactagaaattagatgaagcaagcatgacagacacagctgtggaggtcacagctgctcctttttggtcaatgagcgtttctatcccctccccctggggtgtgctgtgtcccacctggcccaccagaggctcacgacgatggcacctgaccaggtgacgtgggcgtggtcacctcacctgcaaggctttgtggactctgcacaccgtatgacccccggttttacagtttttagctgttgaattttggaaattggcactgggtgaaaaggtcggaggactggctcttgtagtcacagagtggctgcaggcctttgaaaagtggaggaaagaaaagcccttctccttgccccgcacacatttcactcccactgtactgggcttccaagctttggcattcaggcccctatattttctgtaggaaaaatcgttgagaacacttttctatatgggtgattttgagaccatcgttacgctgtgcgtaaagaatgtacagagaaatttgtaggtattttttgaagaacattaatttgttaatgatatgtagctatttaatttttccctttcctattgtaatcattcattttttttgttgttcggaaaaaaaaagttgatctttttttttgtcgtagatttgtctgtaaaagtgcaggaacagttattctatgagaacactgcatctgcattcatagccacgagtttgttattgctacaggctactgagcgtcgtaacaggaaaaccacccacagctgaccggctcggtggaggacactcctgggacaggtctctttgtcagtgaacaagggcgtcactctgggaggggtcggcggtgctggcggccgggtccctggtgcactgacctatctgggataggcagtaccctggaggggggcctggggcagaggaggcagcagaaaaccaaacatttcactgagaaagccccctccctgctctaagaaggggctccgtgaagttcttcccagagccgcgctgcctgcagtgcgctctgaccttctcttcatgtgtgtaaatctgtaatataccattctctgtggcctgtttttcctggaagaagaaaaaaaaaggtttggcaggccatctttttttgtacttaaaagtagccttaagaacaataataaagtgctcttaaacc

SEQ ID NO: 369178 - DNA, 3284 bp, Homo sapiens
ctgaccaggagcggaggcgacttccatctcccgggcaggatgcgtgcggttttctgccgtccccgggagcacatgacgcctgggaagcagtggccgggaggtgattcatccgggcgagcggggcctggaaaacaatgtctgtcttgaagctccgggaaccaggaaaatgagctggaaatgaacaagactgccaatggagactgccgcagagacccccgggagcggagccgcagccccatcgagcgcgctgtggcccccaccatgagcctgcacggcagccacctgtacacctccctccccagccttggcctggagcagcccctcgcactgaccaagaacagcctggacgccagcaggccagccggcctctcgcccacactgaccccgggggagcggcagcagaaccggccctccgtgatcacctgtgcctcggctggcgcccgcaactgcaacctctcgcactgccccatcgcgcacagcggctgtgccgcgcccgggcctgccagctaccggaggccaccgagcgctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaatcatgggggtggggtggggggaagggaagggatggtttatttgcaaaaaccatgttgttgggatttgtgttctgtttttgtacttgcttggtatccgtacaagggggccctcaaacatgatagcaggaactacgcgtggaacatctgtctaatgtagcatccttacttcctgcctcagttaccaaagaaacctctgatgcaggtctgctgccccgacggggccaggactccacagcgctttctcagtcacaagccatgatgaattggtgactcagacgctttgtgctttttcctttgcttcttgagaccggggtgtgtgtggctcagcttccacggcgtgtttggttcggtccatgtgtgtgcgtgtgtatacttgaagagaactgtcgtgtctgatttgcactattggaggaggactaaagttgcctgacaactttatgtgttatgccagaactctgagggcaaactgctgaaaaacaaagggtttaaggatgacatttctgaccatttgtgtgtttgttgttgttactgtttttgttttttttaatgtagacaatacagctttggaaggggaagtctcatacaggttataggtctttctctctctagatttcaggtgcttgcaactggactgcagactctaccaatcacgggcattttatcttctctgaacactgcagtttgttagactagagctgaggttggaggattccatagtgctttaaacgtgatgcatgttttaatggagaaaaaatagctggtttctattaattatatagacagtaaacaaaaaccttaatacttactatcttcttttcagaattagtttatttttgtcagttacagtcctagatatacttactgctggtacagttgtactctaagattggtatttgatattcactttactcacaagtagtgcgggaggccagctcctggcaggccctcgcgatgagcagtgggtcagctgcggtgtgggatgctggagtttggctgcaggctgacatcatttatttttgcatccctgtctgctttgttacaagctcccaggggaggtggggtttgtgtcttccaacttccctacatgcagaaactgctccctttgaactctcttggctgaacagcagattactgacagacaatctgtgatatggtgttttatacgcttcctcgtacgctggggccaaggcagtatacattcctctgactttatactgttattactgcatttattatttgctatattaatagctactaactagaaattagatgaagcaagcatgacagacacagctgtggaggtcacagctgctcctttttggtcaatgagcgtttctatcccctccccctggggtgtgctgtgtcccacctggcccaccagaggctcacgacgatggcacctgaccaggtgacgtgggcgtggtcacctcacctgcaaggctttgtggactctgcacaccgtatgacccccggttttacagtttttagctgttgaattttggaaattggcactgggtgaaaaggtcggaggactggctcttgtagtcacagagtggctgcaggcctttgaaaagtggaggaaagaaaagcccttctccttgccccgcacacatttcactcccactgtactgggcttccaagctttggcattcaggcccctatattttctgtaggaaaaatcgttgagaacacttttctatatgggtgattttgagaccatcgttacgctgtgcgtaaagaatgtacagagaaatttgtaggtattttttgaagaacattaatttgttaatgatatgtagctatttaatttttccctttcctattgtaatcattcattttttttgttgttcggaaaaaaaaagttgatctttttttttgtcgtagatttgtctgtaaaagtgcaggaacagttattctatgagaacactgcatctgcattcatagccacgagtttgttattgctacaggctactgagcgtcgtaacaggaaaaccacccacagctgaccggctcggtggaggacactcctgggacaggtctctttgtcagtgaacaagggcgtcactctgggaggggtcggcggtgctggcggccgggtccctggtgcactgacctatctgggataggcagtaccctggaggggggcctggggcagaggaggcagcagaaaaccaaacatttcactgagaaagccccctccctgctctaagaaggggctccgtgaagttcttcccagagccgcgctgcctgcagtgcgctctgaccttctcttcatgtgtgtaaatctgtaatataccattctctgtggcctgtttttcctggaagaagaaaaaaaaaggtttggcaggccatctttttttgtacttaaaagtagccttaagaacaataataaagtgctcttaaacc

SEQ ID NO: 369179 - DNA, 2936 bp, Homo sapiens
agaaaagtgacctgcccaagtgcctgacttagccgggggaggtgggttctgtctgcagagcccacgctgaccgtggcagccagtccggctctgggctgcctgagggagggtgctgcaaccgtgcctgtctgtctgcagccacctgtgtctgactgcctgccttcctgcttgcctgcagctgccaccacctgtgaccccgtggtggaggagcatttccgcaggagcctgggcaagaattacaaggagcccgagccggcacccaactccgtgtccatcacgggctccgtggacgaccactttgccaaagctctgggtgacacgtggctccagatcaaagcggccaaggacggagcatccagcagccctgagtccgcctctcgcaggggccagcccgccagcccctctgcccacatggtcagccacagtcactccccctctgtggtctcctgaagggagcgcctcctccaacaacacgtggatctgcatggtttgcctgagctttgaacagtcagtacttaaaaaaaaaaaaatcatgggggtggggtggggggaagggaagggatggtttatttgcaaaaaccatgttgttgggatttgtgttctgtttttgtacttgcttggtatccgtacaagggggccctcaaacatgatagcaggaactacgcgtggaacatctgtctaatgtagcatccttacttcctgcctcagttaccaaagaaacctctgatgcaggtctgctgccccgacggggccaggactccacagcgctttctcagtcacaagccatgatgaattggtgactcagacgctttgtgctttttcctttgcttcttgagaccggggtgtgtgtggctcagcttccacggcgtgtttggttcggtccatgtgtgtgcgtgtgtatacttgaagagaactgtcgtgtctgatttgcactattggaggaggactaaagttgcctgacaactttatgtgttatgccagaactctgagggcaaactgctgaaaaacaaagggtttaaggatgacatttctgaccatttgtgtgtttgttgttgttactgtttttgttttttttaatgtagacaatacagctttggaaggggaagtctcatacaggttataggtctttctctctctagatttcaggtgcttgcaactggactgcagactctaccaatcacgggcattttatcttctctgaacactgcagtttgttagactagagctgaggttggaggattccatagtgctttaaacgtgatgcatgttttaatggagaaaaaatagctggtttctattaattatatagacagtaaacaaaaaccttaatacttactatcttcttttcagaattagtttatttttgtcagttacagtcctagatatacttactgctggtacagttgtactctaagattggtatttgatattcactttactcacaagtagtgcgggaggccagctcctggcaggccctcgcgatgagcagtgggtcagctgcggtgtgggatgctggagtttggctgcaggctgacatcatttatttttgcatccctgtctgctttgttacaagctcccaggggaggtggggtttgtgtcttccaacttccctacatgcagaaactgctccctttgaactctcttggctgaacagcagattactgacagacaatctgtgatatggtgttttatacgcttcctcgtacgctggggccaaggcagtatacattcctctgactttatactgttattactgcatttattatttgctatattaatagctactaactagaaattagatgaagcaagcatgacagacacagctgtggaggtcacagctgctcctttttggtcaatgagcgtttctatcccctccccctggggtgtgctgtgtcccacctggcccaccagaggctcacgacgatggcacctgaccaggtgacgtgggcgtggtcacctcacctgcaaggctttgtggactctgcacaccgtatgacccccggttttacagtttttagctgttgaattttggaaattggcactgggtgaaaaggtcggaggactggctcttgtagtcacagagtggctgcaggcctttgaaaagtggaggaaagaaaagcccttctccttgccccgcacacatttcactcccactgtactgggcttccaagctttggcattcaggcccctatattttctgtaggaaaaatcgttgagaacacttttctatatgggtgattttgagaccatcgttacgctgtgcgtaaagaatgtacagagaaatttgtaggtattttttgaagaacattaatttgttaatgatatgtagctatttaatttttccctttcctattgtaatcattcattttttttgttgttcggaaaaaaaaagttgatctttttttttgtcgtagatttgtctgtaaaagtgcaggaacagttattctatgagaacactgcatctgcattcatagccacgagtttgttattgctacaggctactgagcgtcgtaacaggaaaaccacccacagctgaccggctcggtggaggacactcctgggacaggtctctttgtcagtgaacaagggcgtcactctgggaggggtcggcggtgctggcggccgggtccctggtgcactgacctatctgggataggcagtaccctggaggggggcctggggcagaggaggcagcagaaaaccaaacatttcactgagaaagccccctccctgctctaagaaggggctccgtgaagttcttcccagagccgcgctgcctgcagtgcgctctgaccttctcttcatgtgtgtaaatctgtaatataccattctctgtggcctgtttttcctggaagaagaaaaaaaaaggtttggcaggccatctttttttgtacttaaaagtagccttaagaacaataataaagtgctcttaaacc

SEQ ID NO: 369180 - DNA, 4166 bp, Homo sapiens
  misc_feature (29)..(29): n is a, c, g, or t
cccgccctcggcgcccccgcccctccagnaaggggaggaggcgaggggagcccgccgcggaggccgagcgagcggcgcccagcccagcctggcgactggggaccccggcacatgaggtggacgcccccggggaagacttgggtgcacagccaggcgagaaggtcttgagtcagacagagcaccagccttggggaccctggaccactatcatggagactgagagcgagcagaactccaattccaccaatgggagttctagctcagggggcagctctcggccccagatagctcaaatgtcactttatgaacgacaagcagtgcaggctctgcaagcactgcagcggcagcccaatgcagctcagtatttccaccagttcatgctccagcagcagctcagtaatgcccagctgcatagcctggctgccgtccagcaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacggccacagctgggaaacctattgcaggtaaaccgaacccctgggtcggaatgtgcctctagcctcccaactcatcctgatgcctaatggggcggtggctgcagtccagcaggaggtgccatctgctcagtctcctggagttcatgcagatgcagatcaggttcagaacttggcagtaaggaatcaacaggcctcagctcaaggacctcagatgcaaggctccactcagaaggccattcctccaggagcctcccctgtctctagcctctcccaggcctctagccaggccctagcggtggcacaggcttcctctggggccacaaaccagtccctcaaccttagtcaagctggtggaggcagtgggaatagcatcccagggtccatgggtccaggtggaggtgggcaggcacatggtggtttgggtcagttgccttcctcaggaatgggtggtgggagctgtcccaggaagggtacaggagtggtgcagcccttgcctgcagcccaaacagtgactgtgagccagggcagccagacagaggcagaaagtgcagcagccaagaaggcagaagcagatgggagtggccagcagaatgtgggcatgaacctgacacggacagccacacctgcgcccagccagacacttattagctcagccacctacacacagatccagccccattcactgattcagcaacagcaacagatccacctccagcagaaacaggtggtgatccagcagcagattgccatccaccaccagcagcagttccagcaccggcagtcccagctccttcacacagctacacacctccagttggcgcagcagcagcagcagcaacaacagcaacagcagcaacagcagcagccgcaagccaccaccctcactgcccctcagccaccacaggtcccacctactcagcaggtcccaccttcccagtcccagcagcaagcccaaaccctggtcgttcagcccatgcttcagtcttcacccttgtctcttccacctgatgcagcccctaagccaccaattcccatccaatccaaaccacctgtagcacctatcaagccgcctcagttaggggccgctaagatgtcagctgcccagcaaccaccaccccatatccctgtgcaagttgtaggcactcgacagccaggtacagcccaggcacaggctttggggttggcacagctggcagctgctgtacctacttcccgggggatgccaggtacagtgcagtctggtcaggcccatttggcctcctcgccaccttcatcccaggctcctggtgcactgcaggagtgccctcccacattggcccctgggatgacccttgctcctgtgcaggggacagcacatgtggtaaagggtggggctaccacctcctcacctgttgtagcccaggtccctgctgccttctatatgcagtctgtgcacttgccgggtaaaccccagacattggctgtcaaacgcaaggctgactctgaggaggagagagatgatgtctccacattgggttcaatgcttcctgccaaggcatctccagtagcagaaagcccaaaagtcatggacgagaagagcagtcttggagaaaaagctgaatcagtggctaatgtgaatgctaatactccaagcagtgaactagtagccttgacccccgccccttcagtaccgcctcctacactagccatggtgtctagacaaatgggtgactcaaaacccccacaggccatcgtgaagccccagattctcacccacatcattgaaggctttgttatccaggaaggagcagaacctttcccggtgggttgttctcagttactgaaggagtctgagaagccactacagactggccttccgacagggctgactgagaatcagtcaggtggccctttgggagtggacagcccatctgctgagttagataagaaggcgaatctcctgaagtgcgagtactgtgggaagtacgcccccgcagagcagtttcgtggctctaagaggttctgctccatgacttgcgctaagaggtacaatgtgagctgtagccatcagttccggctgaagaggaaaaaaatgaaagagtttcaagaagccaactatgctcgcgttcgcaggcgtggaccccgccgcagctcctctgacattgcccgtgccaagattcagggcaagtgccaccggggtcaagaagactctagccggggttcagataattccagttatgatgaagcactctctccaacatctcctgggcctttatcagtaagagctgggcatggagaacgtgacctggggaatcccaatacagctccacctacaccggaattacatggcatcaaccctgtgttcctgtccagtaatcccagccgttggagtgtagaggaggtgtacgagtttattgcttctctccaaggctgccaagagattgcagaggaatttcgctcacaggagattgatggacaggcccttttattacttaaagaagaacatcttatgagtgccatgaacatcaagctgggccctgccctcaagatctgcgccaagataaatgtcctcaaggagacctaaggtggccctcttgcacaaaccagcctaaggcagacactctccactgtccaggttataacctggtaccagcagactttgcagggaagaaagagttgttccaatcatgtaaccttctgtaggggattactgagacagggaagagaagtgcaagaattggttgctggtgctacatggcggcagctttgacattttctctgggttctactttattttttaaaatctttacagttctcaccatttcacgtaccttaatccaatctttataaaagaggcagtctagagaactaggactgctcagccttatcctggagtggagcatttagcccaggtcttaattctccaagaggaggaatacatagtatggtaaggcaaggaactgggtggaatgtcaggttgcctgcccaatgggagaggtagggtttttctagcttgtgtgacagaagtagcaaaatctggtcctcccccctcccagtgtagctgtggctcagagttttttctttttgttgtcacttactcccttgtgattgaattttttctcctgcatccatggcaggatccccagccagtatagagacttggttggcatcttctgctgcagggactaaaagtatttgactggggcacatgtggctgttgtcattctttctgcatcccactgttcccctccaatttatgttattttctaccctgtttttcagttccatctctgctctgtcctatagctttataaaaccagagtgtgtggggctgaggtcaggagtataagtacctgccttaggcactattccttatataacaaaaatattaaatatttttttcctcagtaaaaggatgaaaattggtttcagttgtcttactctattccagtctttgcccactttcacacaaatgacaaggccaatatgttttgtttgttttttaatcattaagagtttttgtac

SEQ ID NO: 369181 - DNA, 3661 bp, Homo sapiens
  misc_feature (29)..(29): n is a, c, g, or t
cccgccctcggcgcccccgcccctccagnaaggggaggaggcgaggggagcccgccgcggaggccgagcgagcggcgcccagcccagcctggcgactggggaccccggcacatgaggtggacgcccccggggaagacttgggtgcacagccaggcgagaaggtcttgagtcagacagagcaccagccttggggaccctggaccactatcatggagactgagagcgagcagaactccaattccaccaatgggagttctagctcagggggcagctctcggccccagatagctcaaatgtcactttatgaacgacaagcagtgcaggctctgcaagcactgcagcggcagcccaatgcagctcagtatttccaccagttcatgctccagcagcagctcagtaatgcccagctgcatagcctggctgccgtccagcaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacggccacagctgggaaacctattgcaggtaaaccgaacccctgggtcggaatgtgcctctagcctcccaactcatcctgatgcctaatggggcggtggctgcagtccagcaggaggtgccatctgctcagtctcctggagttcatgcagatgcagatcaggttcagaacttggcagtaaggaatcaacaggcctcagctcaaggacctcagatgcaaggctccactcagaaggccattcctccaggagcctcccctgtctctagcctctcccaggcctctagccaggccctagcggtggcacaggcttcctctggggccacaaaccagtccctcaaccttagtcaagctggtggaggcagtgggaatagcatcccagggtccatgggtccaggtggaggtgggcaggcacatggtggtttgggtcagttgccttcctcaggaatgggtggtgggagctgtcccaggaagggtacaggagtggtgcagcccttgcctgcagcccaaacagtgactgtgagccagggcagccagacagaggcagaaagtgcagcagccaagaaggcagaagcagatgggagtggccagcagaatgtgggcatgaacctgacacggacagccacacctgcgcccagccagacacttattagctcagccacctacacacagatccagccccattcactgattcagcaacagcaacagatccacctccagcagaaacaggtggtgatccagcagcagattgccatccaccaccagcagcagttccagcaccggcagtcccagctccttcacacagctacacacctccagttggcgcagcagcagcagcagcaacaacagcaacagcagcaacagcagcagccgcaagccaccaccctcactgcccctcagccaccacaggtcccacctactcagcaggtcccaccttcccaggtaaaccccagacattggctgtcaaacgcaaggctgactctgaggaggagagagatgatgtctccacattgggttcaatgcttcctgccaaggcatctccagtagcagaaagcccaaaagtcatggacgagaagagcagtcttggagaaaaagctgaatcagtggctaatgtgaatgctaatactccaagcagtgaactagtagccttgacccccgccccttcagtaccgcctcctacactagccatggtgtctagacaaatgggtgactcaaaacccccacaggccatcgtgaagccccagattctcacccacatcattgaaggctttgttatccaggaaggagcagaacctttcccggtgggttgttctcagttactgaaggagtctgagaagccactacagactggccttccgacagggctgactgagaatcagtcaggtggccctttgggagtggacagcccatctgctgagttagataagaaggcgaatctcctgaagtgcgagtactgtgggaagtacgcccccgcagagcagtttcgtggctctaagaggttctgctccatgacttgcgctaagaggtacaatgtgagctgtagccatcagttccggctgaagaggaaaaaaatgaaagagtttcaagaagccaactatgctcgcgttcgcaggcgtggaccccgccgcagctcctctgacattgcccgtgccaagattcagggcaagtgccaccggggtcaagaagactctagccggggttcagataattccagttatgatgaagcactctctccaacatctcctgggcctttatcagtaagagctgggcatggagaacgtgacctggggaatcccaatacagctccacctacaccggaattacatggcatcaaccctgtgttcctgtccagtaatcccagccgttggagtgtagaggaggtgtacgagtttattgcttctctccaaggctgccaagagattgcagaggaatttcgctcacaggagattgatggacaggcccttttattacttaaagaagaacatcttatgagtgccatgaacatcaagctgggccctgccctcaagatctgcgccaagataaatgtcctcaaggagacctaaggtggccctcttgcacaaaccagcctaaggcagacactctccactgtccaggttataacctggtaccagcagactttgcagggaagaaagagttgttccaatcatgtaaccttctgtaggggattactgagacagggaagagaagtgcaagaattggttgctggtgctacatggcggcagctttgacattttctctgggttctactttattttttaaaatctttacagttctcaccatttcacgtaccttaatccaatctttataaaagaggcagtctagagaactaggactgctcagccttatcctggagtggagcatttagcccaggtcttaattctccaagaggaggaatacatagtatggtaaggcaaggaactgggtggaatgtcaggttgcctgcccaatgggagaggtagggtttttctagcttgtgtgacagaagtagcaaaatctggtcctcccccctcccagtgtagctgtggctcagagttttttctttttgttgtcacttactcccttgtgattgaattttttctcctgcatccatggcaggatccccagccagtatagagacttggttggcatcttctgctgcagggactaaaagtatttgactggggcacatgtggctgttgtcattctttctgcatcccactgttcccctccaatttatgttattttctaccctgtttttcagttccatctctgctctgtcctatagctttataaaaccagagtgtgtggggctgaggtcaggagtataagtacctgccttaggcactattccttatataacaaaaatattaaatatttttttcctcagtaaaaggatgaaaattggtttcagttgtcttactctattccagtctttgcccactttcacacaaatgacaaggccaatatgttttgtttgttttttaatcattaagagtttttgtac

SEQ ID NO: 369182 - DNA, 2384 bp, Homo sapiens
ctattctgggtttttgggtatgtaataagttagatcaagatagccttaaccaaatcagtctttgaaaaaacaacagttcttggttggtctacgtgaatacagggtctcaagacctaggtcaggactaaatcatgttacattttcttttgtcctgatggaaagttactaggaatgaccaggaattttagtgtaccatgggaagtagataaattgggaaatctggaactaagaaaattttctttgaacatatggtaataattgtggttccttattatccttcatttgtacatctttgtttctttcctattctttacggtatagggtaaaccccagacattggctgtcaaacgcaaggctgactctgaggaggagagagatgatgtctccacattgggttcaatgcttcctgccaaggcatctccagtagcagaaagcccaaaagtcatggacgagaagagcagtcttggagaaaaagctgaatcagtggctaatgtgaatgctaatactccaagcagtgaactagtagccttgacccccgccccttcagtaccgcctcctacactagccatggtgtctagacaaatgggtgactcaaaacccccacaggccatcgtgaagccccagattctcacccacatcattgaaggctttgttatccaggaaggagcagaacctttcccggtgggttgttctcagttactgaaggagtctgagaagccactacagactggccttccgacagggctgactgagaatcagtcaggtggccctttgggagtggacagcccatctgctgagttagataagaaggcgaatctcctgaagtgcgagtactgtgggaagtacgcccccgcagagcagtttcgtggctctaagaggttctgctccatgacttgcgctaagaggtacaatgtgagctgtagccatcagttccggctgaagaggaaaaaaatgaaagagtttcaagaagccaactatgctcgcgttcgcaggcgtggaccccgccgcagctcctctgacattgcccgtgccaagattcagggcaagtgccaccggggtcaagaagactctagccggggttcagataattccagttatgatgaagcactctctccaacatctcctgggcctttatcagtaagagctgggcatggagaacgtgacctggggaatcccaatacagctccacctacaccggaattacatggcatcaaccctgtgttcctgtccagtaatcccagccgttggagtgtagaggaggtgtacgagtttattgcttctctccaaggctgccaagagattgcagaggaatttcgctcacaggagattgatggacaggcccttttattacttaaagaagaacatcttatgagtgccatgaacatcaagctgggccctgccctcaagatctgcgccaagataaatgtcctcaaggagacctaaggtggccctcttgcacaaaccagcctaaggcagacactctccactgtccaggttataacctggtaccagcagactttgcagggaagaaagagttgttccaatcatgtaaccttctgtaggggattactgagacagggaagagaagtgcaagaattggttgctggtgctacatggcggcagctttgacattttctctgggttctactttattttttaaaatctttacagttctcaccatttcacgtaccttaatccaatctttataaaagaggcagtctagagaactaggactgctcagccttatcctggagtggagcatttagcccaggtcttaattctccaagaggaggaatacatagtatggtaaggcaaggaactgggtggaatgtcaggttgcctgcccaatgggagaggtagggtttttctagcttgtgtgacagaagtagcaaaatctggtcctcccccctcccagtgtagctgtggctcagagttttttctttttgttgtcacttactcccttgtgattgaattttttctcctgcatccatggcaggatccccagccagtatagagacttggttggcatcttctgctgcagggactaaaagtatttgactggggcacatgtggctgttgtcattctttctgcatcccactgttcccctccaatttatgttattttctaccctgtttttcagttccatctctgctctgtcctatagctttataaaaccagagtgtgtggggctgaggtcaggagtataagtacctgccttaggcactattccttatataacaaaaatattaaatatttttttcctcagtaaaaggatgaaaattggtttcagttgtcttactctattccagtctttgcccactttcacacaaatgacaaggccaatatgttttgtttgttttttaatcattaagagtttttgtac

SEQ ID NO: 369183 - DNA, 1611 bp, Homo sapiens
  misc_feature (29)..(29): n is a, c, g, or t
cccgccctcggcgcccccgcccctccagnaaggggaggaggcgaggggagcccgccgcggaggccgagcgagcggcgcccagcccagcctggcgactggggaccccggcacatgaggtggacgcccccggggaagacttgggtgcacagccaggcgagaaggtcttgagtcagacagagcaccagccttggggaccctggaccactatcatggagactgagagcgagcagaactccaattccaccaatgggagttctagctcagggggcagctctcggccccagatagctcaaatgtcactttatgaacgacaagcagtgcaggctctgcaagcactgcagcggcagcccaatgcagctcagtatttccaccagttcatgctccagcagcagctcagtaatgcccagctgcatagcctggctgccgtccagcaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacggccacagctgggaaacctattgcaggtaaaccgaacccctgggtcggaatgtgcctctagcctcccaactcatcctgatgcctaatggggcggtggctgcagtccagcaggaggtgccatctgctcagtctcctggagttcatgcagatgcagatcaggttcagaacttggcagtaaggaatcaacaggcctcagctcaaggacctcagatgcaaggctccactcagaaggccattcctccaggagcctcccctgtctctagcctctcccaggcctctagccaggccctagcggtggcacaggcttcctctggggccacaaaccagtccctcaaccttagtcaagctggtggaggcagtgggaatagcatcccagggtccatgggtccaggtggaggtgggcaggcacatggtggtttgggtcagttgccttcctcaggaatgggtggtgggagctgtcccaggaagggtacaggagtggtgcagcccttgcctgcagcccaaacagtgactgtgagccagggcagccagacagaggcagaaagtgcagcagccaagaaggcagaagcagatgggagtggccagcagaatgtgggcatgaacctgacacggacagccacacctgcgcccagccagacacttattagctcagccacctacacacagatccagccccattcactgattcagcaacagcaacagatccacctccagcagaaacaggtggtgatccagcagcagattgccatccaccaccagcagcagttccagcaccggcagtcccagctccttcacacagctacacacctccagttggcgcagcagcagcagcagcaacaacagcaacagcagcaacagcagcagccgcaagccaccacccttagtggacaaaaaatctaaaacaggtcacaacgtaatgagcagtccaacatttccgagcttcccgta

SEQ ID NO: 369184 - DNA, 1590 bp, Homo sapiens
  misc_feature (29)..(29): n is a, c, g, or t
cccgccctcggcgcccccgcccctccagnaaggggaggaggcgaggggagcccgccgcggaggccgagcgagcggcgcccagcccagcctggcgactggggaccccggcacatgaggtggacgcccccggggaagacttgggtgcacagccaggcgagaaggtcttgagtcagacagagcaccagccttggggaccctggaccactatcatggagactgagagcgagcagaactccaattccaccaatgggagttctagctcagggggcagctctcggccccagatagctcaaatgtcactttatgaacgacaagcagtgcaggctctgcaagcactgcagcggcagcccaatgcagctcagtatttccaccagttcatgctccagcagcagctcagtaatgcccagctgcatagcctggctgccgtccagcaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacggccacagctgggaaacctattgcaggtaaaccgaacccctgggtcggaatgtgcctctagcctcccaactcatcctgatgcctaatggggcggtggctgcagtccagcaggaggtgccatctgctcagtctcctggagttcatgcagatgcagatcaggttcagaacttggcagtaaggaatcaacaggcctcagctcaaggacctcagatgcaaggctccactcagaaggccattcctccaggagcctcccctgtctctagcctctcccaggcctctagccaggccctagcggtggcacaggcttcctctggggccacaaaccagtccctcaaccttagtcaagctggtggaggcagtgggaatagcatcccagggtccatgggcccaatgggagaggtagggtttttctagcttgtgtgacagaagtagcaaaatctggtcctcccccctcccagtgtagctgtggctcagagttttttctttttgttgtcacttactcccttgtgattgaattttttctcctgcatccatggcaggatccccagccagtatagagacttggttggcatcttctgctgcagggactaaaagtatttgactggggcacatgtggctgttgtcattctttctgcatcccactgttcccctccaatttatgttattttctaccctgtttttcagttccatctctgctctgtcctatagctttataaaaccagagtgtgtggggctgaggtcaggagtataagtacctgccttaggcactattccttatataacaaaaatattaaatatttttttcctcagtaaaaggatgaaaattggtttcagttgtcttactctattccagtctttgcccactttcacacaaatgacaaggccaatatgttttgtttgttttttaatcattaagagtttttgtac

SEQ ID NO: 369185 - DNA, 3458 bp, Homo sapiens
aactcaggggcgagctgctaactcaggggcgagctgctaactcaggggcgagctgcagtccagcaggaggtgccatctgctcagtctcctggagttcatgcagatgcagatcaggttcagaacttggcagtaaggaatcaacaggcctcagctcaaggacctcagatgcaaggctccactcagaaggccattcctccaggagcctcccctgtctctagcctctcccaggcctctagccaggccctagcggtggcacaggcttcctctggggccacaaaccagtccctcaaccttagtcaagctggtggaggcagtgggaatagcatcccagggtccatgggtccaggtggaggtgggcaggcacatggtggtttgggtcagttgccttcctcaggaatgggtggtgggagctgtcccaggaagggtacaggagtggtgcagcccttgcctgcagcccaaacagtgactgtgagccagggcagccagacagaggcagaaagtgcagcagccaagaaggcagaagcagatgggagtggccagcagaatgtgggcatgaacctgacacggacagccacacctgcgcccagccagacacttattagctcagccacctacacacagatccagccccattcactgattcagcaacagcaacagatccacctccagcagaaacaggtggtgatccagcagcagattgccatccaccaccagcagcagttccagcaccggcagtcccagctccttcacacagctacacacctccagttggcgcagcagcagcagcagcaacaacagcaacagcagcaacagcagcagccgcaagccaccaccctcactgcccctcagccaccacaggtcccacctactcagcaggtcccaccttcccagtcccagcagcaagcccaaaccctggtcgttcagcccatgcttcagtcttcacccttgtctcttccacctgatgcagcccctaagccaccaattcccatccaatccaaaccacctgtagcacctatcaagccgcctcagttaggggccgctaagatgtcagctgcccagcaaccaccaccccatatccctgtgcaagttgtaggcactcgacagccaggtacagcccaggcacaggctttggggttggcacagctggcagctgctgtacctacttcccgggggatgccaggtacagtgcagtctggtcaggcccatttggcctcctcgccaccttcatcccaggctcctggtgcactgcaggagtgccctcccacattggcccctgggatgacccttgctcctgtgcaggggacagcacatgtggtaaagggtggggctaccacctcctcacctgttgtagcccaggtccctgctgccttctatatgcagtctgtgcacttgccgggtaaaccccagacattggctgtcaaacgcaaggctgactctgaggaggagagagatgatgtctccacattgggttcaatgcttcctgccaaggcatctccagtagcagaaagcccaaaagtcatggacgagaagagcagtcttggagaaaaagctgaatcagtggctaatgtgaatgctaatactccaagcagtgaactagtagccttgacccccgccccttcagtaccgcctcctacactagccatggtgtctagacaaatgggtgactcaaaacccccacaggccatcgtgaagccccagattctcacccacatcattgaaggctttgttatccaggaaggagcagaacctttcccggtgggttgttctcagttactgaaggagtctgagaagccactacagactggccttccgacagggctgactgagaatcagtcaggtggccctttgggagtggacagcccatctgctgagttagataagaaggcgaatctcctgaagtgcgagtactgtgggaagtacgcccccgcagagcagtttcgtggctctaagaggttctgctccatgacttgcgctaagaggtacaatgtgagctgtagccatcagttccggctgaagaggaaaaaaatgaaagagtttcaagaagccaactatgctcgcgttcgcaggcgtggaccccgccgcagctcctctgacattgcccgtgccaagattcagggcaagtgccaccggggtcaagaagactctagccggggttcagataattccagttatgatgaagcactctctccaacatctcctgggcctttatcagtaagagctgggcatggagaacgtgacctggggaatcccaatacagctccacctacaccggaattacatggcatcaaccctgtgttcctgtccagtaatcccagccgttggagtgtagaggaggtgtacgagtttattgcttctctccaaggctgccaagagattgcagaggaatttcgctcacaggagattgatggacaggcccttttattacttaaagaagaacatcttatgagtgccatgaacatcaagctgggccctgccctcaagatctgcgccaagataaatgtcctcaaggagacctaaggtggccctcttgcacaaaccagcctaaggcagacactctccactgtccaggttataacctggtaccagcagactttgcagggaagaaagagttgttccaatcatgtaaccttctgtaggggattactgagacagggaagagaagtgcaagaattggttgctggtgctacatggcggcagctttgacattttctctgggttctactttattttttaaaatctttacagttctcaccatttcacgtaccttaatccaatctttataaaagaggcagtctagagaactaggactgctcagccttatcctggagtggagcatttagcccaggtcttaattctccaagaggaggaatacatagtatggtaaggcaaggaactgggtggaatgtcaggttgcctgcccaatgggagaggtagggtttttctagcttgtgtgacagaagtagcaaaatctggtcctcccccctcccagtgtagctgtggctcagagttttttctttttgttgtcacttactcccttgtgattgaattttttctcctgcatccatggcaggatccccagccagtatagagacttggttggcatcttctgctgcagggactaaaagtatttgactggggcacatgtggctgttgtcattctttctgcatcccactgttcccctccaatttatgttattttctaccctgtttttcagttccatctctgctctgtcctatagctttataaaaccagagtgtgtggggctgaggtcaggagtataagtacctgccttaggcactattccttatataacaaaaatattaaatatttttttcctcagtaaaaggatgaaaattggtttcagttgtcttactctattccagtctttgcccactttcacacaaatgacaaggccaatatgttttgtttgttttttaatcattaagagtttttgtac

SEQ ID NO: 369186 - DNA, 2186 bp, Homo sapiens
  misc_feature (29)..(29): n is a, c, g, or t
cccgccctcggcgcccccgcccctccagnaaggggaggaggcgaggggagcccgccgcggaggccgagcgagcggcgcccagcccagcctggcgactggggaccccggcacatgaggtggacgcccccggggaagacttgggtgcacagccaggcgagaaggtcttgagtcagacagagcaccagccttggggaccctggaccactatcatggagactgagagcgagcagaactccaattccaccaatgggagttctagctcagggggcagctctcggccccagatagctcaaatgtcactttatgaacgacaagcagtgcaggctctgcaagcactgcagcggcagcccaatgcagctcagtatttccaccagttcatgctccagcagcagctcagtaatgcccagctgcatagcctggctgccgtccagcaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacggccacagctgggaaacctattgcaggtaaaccgaacccctgggtcggaatgtgcctctagcctcccaactcatcctgatgcctaatggggcggtggctgcagtccagcaggaggtgccatctgctcagtctcctggagttcatgcagatgcagatcaggttcagaacttggcagtaaggaatcaacaggcctcagctcaaggacctcagatgcaaggctccactcagaaggccattcctccaggagcctcccctgtctctagcctctcccaggcctctagccaggccctagcggtggcacaggcttcctctggggccacaaaccagtccctcaaccttagtcaagctggtggaggcagtgggaatagcatcccagggtccatgggtccaggtggaggtgggcaggcacatggtggtttgggtcagttgccttcctcaggaatgggtggtgggagctgtcccaggaagggtacaggagtggtgcagcccttgcctgcagcccaaacagtgactgtgagccagggcagccagacagaggcagaaagtgcagcagccaagaaggcagaagcagatgggagtggccagcagaatgtgggcatgaacctgacacggacagccacacctgcgcccagccagacacttattagctcagccacctacacacagatccagccccattcactgattcagcaacagcaacagatccacctccagcagaaacaggtggtgatccagcagcagattgccatccaccaccagcagcagttccagcaccggcagtcccagctccttcacacagctacacacctccagttggcgcagcagcagcagcagcaacaacagcaacagcagcaacagcagcagccgcaagccaccaccctcactgcccctcagccaccacaggtcccacctactcagcaggtcccaccttcccagtcccagcagcaagcccaaaccctggtcgttcagcccatgcttcagtcttcacccttgtctcttccacctgatgcagcccctaagccaccaattcccatccaatccaaaccacctgtagcacctatcaagccgcctcagttaggggccgctaagatgtcagctgcccagcaaccaccaccccatatccctgtgcaagttgtaggcactcgacagccaggtacagcccaggcacaggctttggggttggcacagctggcagctgctgtacctacttcccgggggatgccaggtacagtgcagtctggtcaggcccatttggcctcctcgccaccttcatcccaggctcctggtgcactgcaggagtgccctcccacattggcccctgggatgacccttgctcctgtgcaggggacagcacatgtggtaaagggtggggctaccacctcctcacctgttgtagcccaggtccctgctgccttctatatgcagtctgtgcacttgccggtgagtgatgtctgatggttttgagggcactattatgcatgagagtggacctgggctaagtggaaatagagcttaattgaata

SEQ ID NO: 369187 - DNA, 1661 bp, Homo sapiens
  misc_feature (29)..(29): n is a, c, g, or t
cccgccctcggcgcccccgcccctccagnaaggggaggaggcgaggggagcccgccgcggaggccgagcgagcggcgcccagcccagcctggcgactggggaccccggcacatgaggtggacgcccccggggaagacttgggtgcacagccaggcgagaaggtcttgagtcagacagagcaccagccttggggaccctggaccactatcatggagactgagagcgagcagaactccaattccaccaatgggagttctagctcagggggcagctctcggccccagatagctcaaatgtcactttatgaacgacaagcagtgcaggctctgcaagcactgcagcggcagcccaatgcagctcagtatttccaccagttcatgctccagcagcagctcagtaatgcccagctgcatagcctggctgccgtccagcaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacggccacagctgggaaacctattgcaggtaaaccgaacccctgggtcggaatgtgcctctagcctcccaactcatcctgatgcctaatggggcggtggctgcagtccagcaggaggtgccatctgctcagtctcctggagttcatgcagatgcagatcaggttcagaacttggcagtaaggaatcaacaggcctcagctcaaggacctcagatgcaaggctccactcagaaggccattcctccaggagcctcccctgtctctagcctctcccaggcctctagccaggccctagcggtggcacaggcttcctctggggccacaaaccagtccctcaaccttagtcaagctggtggaggcagtgggaatagcatcccagggtccatgggtccaggtggaggtgggcaggcacatggtggtttgggtcagttgccttcctcaggaatgggtggtgggagctgtcccaggaagggtacaggagtggtgcagcccttgcctgcagcccaaacagtgactgtgagccagggcagccagacagaggcagaaagtgcagcagccaagaaggcagaagcagatgggagtggccagcagaatgtgggcatgaacctgacacggacagccacacctgcgcccagccagacacttattagctcagccacctacacacagatccagccccattcaatgtggctgttgtcattctttctgcatcccactgttcccctccaatttatgttattttctaccctgtttttcagttccatctctgctctgtcctatagctttataaaaccagagtgtgtggggctgaggtcaggagtataagtacctgccttaggcactattccttatataacaaaaatattaaatatttttttcctcagtaaaaggatgaaaattggtttcagttgtcttactctattccagtctttgcccactttcacacaaatgacaaggccaatatgttttgtttgttttttaatcattaagagtttttgtac

SEQ ID NO: 369188 - DNA, 418 bp, Homo sapiens
actgatggtattataaggggcttcccccttcagtgggcactcattcttctccttcccgccattatgtgaagaaggacatgtttgcttccccttctgccatgattgtaagtttcctgaggcctccccagccatgctgaactgtgagttaattacacctctttcgtttataaattgttcagtctcaggtatgtcttatttagcagtgtaagaacagactaatatagtaaattggtgctgcagagagtggggtgctactgtaaaaatacctgaaaatgtggaagcgactttggaactgggtaacaggcagaggttggaacagtttgtaggactcagaagaagacaggaagatgtgggaaagtttggaacttcctagagacttgttgaatggctttgaccaaaagcctgatagcaatatgga

SEQ ID NO: 369189 - DNA, 4908 bp, Homo sapiens
atttgacctcgacagggaacgcaagcaaaaccacacatttaaaacagacttggtaaaatcagctcgttatttaaagaaacggacgattcctttttctctcctggtttagtcttcgacccacaggccccttgcttctttcgaacggcggctgtatcccatgaccttttcactttccaagccaacggactgggggtcgttacacacgcggagggcccggaacgcacggctcctcgcctgcaaattccgagcagtccggattttggggctgcctcccggccacaccagccagcagctcgcacccacatggaggcagggccctggccctcgccccggaccggcgcgtggcggggcgcgtgggtcttcgagggcccgcgacgcggcgcacatgccggtgcccgcctcccgcgtcggcgagaagacagggagctcggacacggggaggctgacccggagcctacccatgaggcagcgcgccggctgcacgagagcccccccctttccacggctcggctgccagctccgcaatgggagccgccgccgtcgccgcagtgtagtttttcgtgctcctccttttcctcctcctctttctcctcctcctcagggctccagtcaggccgatccgctccgctcacggaaggaaaacagaaataacttgctggcttgtctggagtcacatggtaattcaaaaatggcagaactgtttatggaatgtgaagaagaggagctggaaccatggcagaagaaagtaaaagaagttgaggatgacgatgatgatgagccaatctttgttggcgagatatcaagttcaaaaccagcaatttcaaatattttgaacagagttaaccccagctcatattcaaggggactaaagaatggtgcactcagtcgaggtattactgctgcattcaagcctacaagtcaacactacacgaatccaacatcaaatccagtgcctgcctcaccaataaattttcatcctgagtctagatcttcagatagttctgttattgttcagcctttttctaaacctggttatataacaaactcatcacgagttgtgtctaataagtcatcagagttactgtttgacttgacccaggatacaggattatcacattaccaagggggaccaacactttctatggcaggtatgagtgaaagttcatttttatcaaaacgtccttctacttctgaagtaaataatgttaatccaaagaagcctaaacccagcgaaagtgtttctggagcaaattcctcagctgtattaccttcagttaaatctccttcagtgacttcttcccaggctatgctagcaaaaggtacaaatacctcatcaaatcagtctaaaaatggaacaccttttccaagagcttgtccaaagtgcaacattcatttcaatcttttggatcctttgaaaaatcacatgaagtattgttgtccagacatgataaataactttttgggactggctaaaacagaattttcaagtacagtaaataaaaacacaactattgattcagagaaaggaaaattgatcatgttagttaatgacttttattatggaaaacatgaaggagatgtccaggaggaacagaagactcacacaacctttaaatgcttcagttgcttgaaaattctaaaaaataacattaggtttatgaaccacatgaaacaccatttggaacttgagaagcagagcagtgagagctgggaaaaccataccacctgccagcactgctaccgtcagtttcccacaccatttcagttgcagtgtcacatcgaaagtacacatacgccccatgaattttctactatttgtaaaatctgtgaattgtcatttgaaacagaacatgttcttttacaacatatgaaggacaatcataaacctggtgaaatgccatatgtctgccaggtttgtaattatagatcatcatcattttctgatgtagaaactcattttagaacatcccatgaaaacactaagaacttgctatgcccgttttgcctcaaagttattaaaattgcaacaccatatatgcatcattatatgaagcatcagaaaaaaggaatacatcgttgtacaaaatgcaggctgcagtttttgacatgcaaggagaaaatggatcataagactcaacaccatcgaacatttataaaacctaaacaactagaaggattgcctcctggaacaaaagttactattcgagcttcagttggacctctgcaatcaggagcttcacctacaccttccattagtgcaagtgcttctacccttcagctctcacctccaaggactaaaaatataactgctaaaaatcctgcaaaatctaatacaagtaaacctaatacaatcaaatccaacgcaagtaaacctaatacaagtaagcctaatggaagtaaatctaaatacaaaccaaaaatctctaatatgcaaaagaaacaaagcacattggctagtagcaataaaaaaagtaaagtcaatacagcattgaggaatttaaggtatcgtcggggcattcacaaatgcattgagtgttgttccgaaataaaagattttgcaaaccactttcctacgtacgtccactgtagtttttgcagatacaacactagctgtagcaaagcctatgtaaatcatatgatgagctttcatagtaaccgtccaagcaaaaggttttgtatttttaagaagcattcagaaaatctccggggcattactctagtgtgccttaattgtgatttcctaagtgatgtttctggcttagataatatggctacacacttaagtcaacataaaactcatacttgccaagttgtaatgcagaaagtttctgtttgtatcccaacttctgagcacctttctgaattaaaaaaagaagctcccgcaaaggaacaagaacctgtgtctaaggaaattgcaagacctaacatggctgaaagagaaacagaaacatcaaattctgaaagtaaacaagataaagctgcttcttcaaaagaaaaaaatggatgtaatgcaaattcatttgaaggctcatcaacaacaaaaagtgaagaaagcataacagtttcagataaggaaaatgaaacctgtcttgcagaccaggaaactggctcaaaaaacatcgtcagttgtgattcaaatattggtgcagataaagtggaaaagaaaaaacaaatacaacacgtttgtcaggaaatggagttgaagatgtgccaaagttcagaaaacataatcttatctgatcagattaaagatcacaactccagtgaagccagattttcttcaaagaatattaaggatttgcgattagcatcagataatgtaagcattgatcagtttttgagaaaaagacatgaacctgaatctgttagttctgatgttagcgagcaaggcagtattcatttggaacctctgactccatccgaggtacttgagtatgaagccacagagattcttcagaaaggtagtggtgatccttcagccaagactgatgaagtagtgtctgatcaaacagatgacattcctggaggaaataaccctagcacaacagaggcaacagtagacctggaagatgaaaaagaaagaagttgaaattagtcattttaagtttcagtgtaccaacgataagggcatttggaacagtgctatcaggtgagctcagtggtgctgttgtaggttcagaaatggaaatatgtaagggaggtcacacatacactttacctgtatgttcaacctatgttatcaaacaaatcaattcaccaataatagcatgattagtagggattcccaaaaagtttttaaaaacacgaacaggattttaatgataattaaatttgcagtggaaaggtctcatttaatggttttcaaggaaatgggatttggttgctgacatgaattgatgatattagtaatatttataaagcctttcaaacttccatcaatcctaagctaaaaatctttattacctgtatatccttttcagttaactgagaggaagggatttggaaaccatgtacttttggggagtaattgattaaaaacaatggctgattggcattgttaatgaaggctttatttgtgaggatgatgctggtaaatggagcatgcttagagtactaaattgatctaatgagaatttggatgaacataaacttaattttggatttaatataacattccagtcagacgcatgtaaacagaatatttgaatctttgtacctccatacaagtgttagcctgccaggctgtaagcttaccttaattaaactttcagtgaaagtggaattattaagatataaatttatatttgtgctttttgtcagtgtgtaagctgtgtagaaattctttgatgtattagttgtattaatgtaaagtagaaacccattgttgaaactcctgtagctattatgcttttaatattgttttaatgatcttccttagaaataggcccataaaaatggtctggaagccaaaccaaagtatggtataatgtagatattgtaaagcagtaaactgaaaacatgtcctggcatgtattcagccatgtttaagtgacttttctgtaattgtaaaataaaaacttcaaatgggacctaaaacagtgatgtaaaagaactggttttggaaatttagcctaatttatctataagatggctgctaaattgatttttcagttctttttatcatctagaatataatagatatagaaatgaataatatgaagaacagtagtttgctttgaaatactaataaacttttatttaaaatgcttcatttttacttcttaaaatgtgctttggattcttaaattttgtttcactgaatgttcaatgttttaaatggcgattaaaatactctgctgtatatagtagtttttgagtaaatatttgcaataaaaatctgcccccgaa

SEQ ID NO: 369190 - DNA, 2776 bp, Homo sapiens
  misc_feature (752)..(752): n is a, c, g, or t
ggttaagaggtagatatagatttgaatctttactacttattgtggtattgccttgggttcccactcaagtcttatttctcatatattgaaatagtgtttataaaatctaatatgtagattaaatgagatagtgcatgtaaagttcttaatatactgcttcatgcatcatatgtactccatagctggtaattgttacaagctgttaggttggcctatggcttactgaggttttacacttttcttgcttccctgtaaaacatttgaaataagtagaatgtttcttactttgtgtactgtttcatgtttttggtttgacagtggaagggttaccatgactcaatatgaaatcataaattcagaaatgttttatctaaatacctgtgcctaatatatttatataaaatactgtggatgcatcttgttattcaaattcaagttgtgttttactagttttctatttaagtaattgtaattatgatccacatttgaaatagaggttacgaaaagcagatattgacatgagtgggtaactgcttttttaccttgaatcagaaacttttggtacactgaaacttttataggtttaaaaacattttcaaaacctgcatataattatggagtattctaattatattttatatttaataaattatttttctatttctttgttatattaagttgcacacttgtttcttttatccagaaagtttagtataataaaaatagttttaagattaactgtgaatgtaaangaaaagtattattaattatttcaggaaattgcaagacctaacatggctgaaagagaaacagaaacatcaaattctgaaagtaaacaagataaagctgcttcttcaaaagaaaaaaatggatgtaatgcaaattcatttgaaggctcatcaacaacaaaaagtgaagaaagcataacagtttcagataaggaaaatgaaacctgtcttgcagaccaggaaactggctcaaaaaacatcgtcagttgtgattcaaatattggtgcagataaagtggaaaagaaaaaacaaatacaacacgtttgtcaggaaatggagttgaagatgtgccaaagttcagaaaacataatcttatctgatcagattaaagatcacaactccagtgaagccagattttcttcaaagaatattaaggatttgcgattagcatcagataatgtaagcattgatcagtttttgagaaaaagacatgaacctgaatctgttagttctgatgttagcgagcaaggcagtattcatttggaacctctgactccatccgaggtacttgagtatgaagccacagagattcttcagaaaggtagtggtgatccttcagccaagactgatgaagtagtgtctgatcaaacagatgacattcctggaggaaataaccctagcacaacagaggcaacagtagacctggaagatgaaaaagaaagaagttgaaattagtcattttaagtttcagtgtaccaacgataagggcatttggaacagtgctatcaggtgagctcagtggtgctgttgtaggttcagaaatggaaatatgtaagggaggtcacacatacactttacctgtatgttcaacctatgttatcaaacaaatcaattcaccaataatagcatgattagtagggattcccaaaaagtttttaaaaacacgaacaggattttaatgataattaaatttgcagtggaaaggtctcatttaatggttttcaaggaaatgggatttggttgctgacatgaattgatgatattagtaatatttataaagcctttcaaacttccatcaatcctaagctaaaaatctttattacctgtatatccttttcagttaactgagaggaagggatttggaaaccatgtacttttggggagtaattgattaaaaacaatggctgattggcattgttaatgaaggctttatttgtgaggatgatgctggtaaatggagcatgcttagagtactaaattgatctaatgagaatttggatgaacataaacttaattttggatttaatataacattccagtcagacgcatgtaaacagaatatttgaatctttgtacctccatacaagtgttagcctgccaggctgtaagcttaccttaattaaactttcagtgaaagtggaattattaagatataaatttatatttgtgctttttgtcagtgtgtaagctgtgtagaaattctttgatgtattagttgtattaatgtaaagtagaaacccattgttgaaactcctgtagctattatgcttttaatattgttttaatgatcttccttagaaataggcccataaaaatggtctggaagccaaaccaaagtatggtataatgtagatattgtaaagcagtaaactgaaaacatgtcctggcatgtattcagccatgtttaagtgacttttctgtaattgtaaaataaaaacttcaaatgggacctaaaacagtgatgtaaaagaactggttttggaaatttagcctaatttatctataagatggctgctaaattgatttttcagttctttttatcatctagaatataatagatatagaaatgaataatatgaagaacagtagtttgctttgaaatactaataaacttttatttaaaatgcttcatttttacttcttaaaatgtgctttggattcttaaattttgtttcactgaatgttcaatgttttaaatggcgattaaaatactctgctgtatatagtagtttttgagtaaatatttgcaataaaaatctgcccccgaa

SEQ ID NO: 369191 - DNA, 742 bp, Homo sapiens
caagacccatggtcctcacaccacagcccacccccgtgtctcttcagtcgtaggaaaggagaccaaaggggattcgggatttgcaggcacagggcccctcattttgcccagatgaccggtcgttccacgtttgcaccctcatttttgtcaaagagacctcccctcctctgccatagaattcccgttattgtctacagaagaagggccctgaggagaaacgtggagttggagacaaaattttctgagctttgcaaggttcacttactgagacggaaagaatgatctcactctgaggttttagcctgctccagcgatggaaggaattcctcccaacttatctcaagttttaacgcttttaaggagaaatctgctggagaggaaaaacgtcaaggtgaacccgcttctgcaagcacgggagacctttggccaaaggcctttgtttgcgaagatttgttaaaaaaaaaaaaatctgtcatcttaaatatttggctttattttcaggtttggacagaatttgtcttttttagtgccatgaaacataaaatggaacgctagaaggacagttttaaagcacaaaagctgcctcttagcatctgtaaggtgtcctgctttgggggactgctgtgccaactccagctgtctccacgcagaaacttaaccagggaaggcactggtttgcttataccattgttagggctgtgtgcctctgatgttttaacatcactacaaatactgttgtaaa

SEQ ID NO: 369192 - DNA, 5089 bp, Homo sapiens
atttgacctcgacagggaacgcaagcaaaaccacacatttaaaacagacttggtaaaatcagctcgttatttaaagaaacggacgattcctttttctctcctggtttagtcttcgacccacaggccccttgcttctttcgaacggcggctgtatcccatgaccttttcactttccaagccaacggactgggggtcgttacacacgcggagggcccggaacgcacggctcctcgcctgcaaattccgagcagtccggattttggggctgcctcccggccacaccagccagcagctcgcacccacatggaggcagggccctggccctcgccccggaccggcgcgtggcggggcgcgtgggtcttcgagggcccgcgacgcggcgcacatgccggtgcccgcctcccgcgtcggcgagaagacagggagctcggacacggggaggctgacccggagcctacccatgaggcagcgcgccggctgcacgagagcccccccctttccacggctcggctgccagctccgcaatgggagccgccgccgtcgccgcagtgtagtttttcgtgctcctccttttcctcctcctctttctcctcctcctcagggctccagtcaggccgatccgctccgctcacggaaggaaaacagaaataacttgctggcttgtctggagtcacatgtacttaggtgacaatttacagaaagtcatctctgcagcttgatgggcgacaacccttttcaaccaaaaagtaattcaaaaatggcagaactgtttatggaatgtgaagaagaggagctggaaccatggcagaagaaagtaaaagaagttgaggatgacgatgatgatgagccaatctttgttggcgagatatcaagttcaaaaccagcaatttcaaatattttgaacagagttaaccccagctcatattcaaggggactaaagaatggtgcactcagtcgaggtattactgctgcattcaagcctacaagtcaacactacacgaatccaacatcaaatccagtgcctgcctcaccaataaattttcatcctgagtctagatcttcagatagttctgttattgttcagcctttttctaaacctggttatataacaaactcatcacgagttgtgtctaataagtcatcagagttactgtttgacttgacccaggatacaggattatcacattaccaagggggaccaacactttctatggcaggtatgagtgaaagttcatttttatcaaaacgtccttctacttctgaagtaaataatgttaatccaaagaagcctaaacccagcgaaagtgtttctggagcaaattcctcagctgtattaccttcagttaaatctccttcagtgacttcttcccaggctatgctagcaaaaggtacaaatacctcatcaaatcagtctaaaaatggaacaccttttccaagagcttgtccaaagtgcaacattcatttcaatcttttggatcctttgaaaaatcacatgaagtattgttgtccagacatgataaataactttttgggactggctaaaacagaattttcaagtacagtaaataaaaacacaactattgattcagagaaaggaaaattgatcatgttagttaatgacttttattatggaaaacatgaaggagatgtccaggaggaacagaagactcacacaacctttaaatgcttcagttgcttgaaaattctaaaaaataacattaggtttatgaaccacatgaaacaccatttggaacttgagaagcagagcagtgagagctgggaaaaccataccacctgccagcactgctaccgtcagtttcccacaccatttcagttgcagtgtcacatcgaaagtacacatacgccccatgaattttctactatttgtaaaatctgtgaattgtcatttgaaacagaacatgttcttttacaacatatgaaggacaatcataaacctggtgaaatgccatatgtctgccaggtttgtaattatagatcatcatcattttctgatgtagaaactcattttagaacatcccatgaaaacactaagaacttgctatgcccgttttgcctcaaagttattaaaattgcaacaccatatatgcatcattatatgaagcatcagaaaaaaggaatacatcgttgtacaaaatgcaggctgcagtttttgacatgcaaggagaaaatggatcataagactcaacaccatcgaacatttataaaacctaaacaactagaaggattgcctcctggaacaaaagttactattcgagcttcagttggacctctgcaatcaggagcttcacctacaccttccattagtgcaagtgcttctacccttcagctctcacctccaaggactaaaaatataactgctaaaaatcctgcaaaatctaatacaagtaaacctaatacaatcaaatccaacgcaagtaaacctaatacaagtaagcctaatggaagtaaatctaaatacaaaccaaaaatctctaatatgcaaaagaaacaaagcacattggctagtagcaataaaaaaagtaaagtcaatacagcattgaggaatttaaggtatcgtcggggcattcacaaatgcattgagtgttgttccgaaataaaagattttgcaaaccactttcctacgtacgtccactgtagtttttgcagatacaacactagctgtagcaaagcctatgtaaatcatatgatgagctttcatagtaaccgtccaagcaaaaggttttgtatttttaagaagcattcagaaaatctccgatgcgtgggaggacaaatagaatgtgacttgcctaagttacacaagttggttgtggagccaagactgactctaggtcttctgactcctaacttttaacaattggtatgacaggggcattactctagtgtgccttaattgtgatttcctaagtgatgtttctggcttagataatatggctacacacttaagtcaacataaaactcatacttgccaagttgtaatgcagaaagtttctgtttgtatcccaacttctgagcacctttctgaattaaaaaaagaagctcccgcaaaggaacaagaacctgtgtctaaggaaattgcaagacctaacatggctgaaagagaaacagaaacatcaaattctgaaagtaaacaagataaagctgcttcttcaaaagaaaaaaatggatgtaatgcaaattcatttgaaggctcatcaacaacaaaaagtgaagaaagcataacagtttcagataaggaaaatgaaacctgtcttgcagaccaggaaactggctcaaaaaacatcgtcagttgtgattcaaatattggtgcagataaagtggaaaagaaaaaacaaatacaacacgtttgtcaggaaatggagttgaagatgtgccaaagttcagaaaacataatcttatctgatcagattaaagatcacaactccagtgaagccagattttcttcaaagaatattaaggatttgcgattagcatcagataatgtaagcattgatcagtttttgagaaaaagacatgaacctgaatctgttagttctgatgttagcgagcaaggcagtattcatttggaacctctgactccatccgaggtacttgagtatgaagccacagagattcttcagaaaggtagtggtgatccttcagccaagactgatgaagtagtgtctgatcaaacagatgacattcctggaggaaataaccctagcacaacagaggcaacagtagacctggaagatgaaaaagaaagaagttgaaattagtcattttaagtttcagtgtaccaacgataagggcatttggaacagtgctatcaggtgagctcagtggtgctgttgtaggttcagaaatggaaatatgtaagggaggtcacacatacactttacctgtatgttcaacctatgttatcaaacaaatcaattcaccaataatagcatgattagtagggattcccaaaaagtttttaaaaacacgaacaggattttaatgataattaaatttgcagtggaaaggtctcatttaatggttttcaaggaaatgggatttggttgctgacatgaattgatgatattagtaatatttataaagcctttcaaacttccatcaatcctaagctaaaaatctttattacctgtatatccttttcagttaactgagaggaagggatttggaaaccatgtacttttggggagtaattgattaaaaacaatggctgattggcattgttaatgaaggctttatttgtgaggatgatgctggtaaatggagcatgcttagagtactaaattgatctaatgagaatttggatgaacataaacttaattttggatttaatataacattccagtcagacgcatgtaaacagaatatttgaatctttgtacctccatacaagtgttagcctgccaggctgtaagcttaccttaattaaactttcagtgaaagtggaattattaagatataaatttatatttgtgctttttgtcagtgtgtaagctgtgtagaaattctttgatgtattagttgtattaatgtaaagtagaaacccattgttgaaactcctgtagctattatgcttttaatattgttttaatgatcttccttagaaataggcccataaaaatggtctggaagccaaaccaaagtatggtataatgtagatattgtaaagcagtaaactgaaaacatgtcctggcatgtattcagccatgtttaagtgacttttctgtaattgtaaaataaaaacttcaaatgggacctaaaacagtgatgtaaaagaactggttttggaaatttagcctaatttatctataagatggctgctaaattgatttttcagttctttttatcatctagaatataatagatatagaaatgaataatatgaagaacagtagtttgctttgaaatactaataaacttttatttaaaatgcttcatttttacttcttaaaatgtgctttggattcttaaattttgtttcactgaatgttcaatgttttaaatggcgattaaaatactctgctgtatatagtagtttttgagtaaatatttgcaataaaaatctgcccccgaa

SEQ ID NO: 369193 - DNA, 5020 bp, Homo sapiens
atttgacctcgacagggaacgcaagcaaaaccacacatttaaaacagacttggtaaaatcagctcgttatttaaagaaacggacgattcctttttctctcctggtttagtcttcgacccacaggccccttgcttctttcgaacggcggctgtatcccatgaccttttcactttccaagccaacggactgggggtcgttacacacgcggagggcccggaacgcacggctcctcgcctgcaaattccgagcagtccggattttggggctgcctcccggccacaccagccagcagctcgcacccacatggaggcagggccctggccctcgccccggaccggcgcgtggcggggcgcgtgggtcttcgagggcccgcgacgcggcgcacatgccggtgcccgcctcccgcgtcggcgagaagacagggagctcggacacggggaggctgacccggagcctacccatgaggcagcgcgccggctgcacgagagcccccccctttccacggctcggctgccagctccgcaatgggagccgccgccgtcgccgcagtgtagtttttcgtgctcctccttttcctcctcctctttctcctcctcctcagggctccagtcaggccgatccgctccgctcacggaaggaaaacagaaataacttgctggcttgtctggagtcacatggtaattcaaaaatggcagaactgtttatggaatgtgaagaagaggagctggaaccatggcagaagaaagtaaaagaagttgaggatgacgatgatgatgagccaatctttgttggcgagatatcaagttcaaaaccagcaatttcaaatattttgaacagagttaaccccagctcatattcaaggggactaaagaatggtgcactcagtcgaggtattactgctgcattcaagcctacaagtcaacactacacgaatccaacatcaaatccagtgcctgcctcaccaataaattttcatcctgagtctagatcttcagatagttctgttattgttcagcctttttctaaacctggttatataacaaactcatcacgagttgtgtctaataagtcatcagagttactgtttgacttgacccaggatacaggattatcacattaccaagggggaccaacactttctatggcaggtatgagtgaaagttcatttttatcaaaacgtccttctacttctgaagtaaataatgttaatccaaagaagcctaaacccagcgaaagtgtttctggagcaaattcctcagctgtattaccttcagttaaatctccttcagtgacttcttcccaggctatgctagcaaaaggtacaaatacctcatcaaatcagtctaaaaatggaacaccttttccaagagcttgtccaaagtgcaacattcatttcaatcttttggatcctttgaaaaatcacatgaagtattgttgtccagacatgataaataactttttgggactggctaaaacagaattttcaagtacagtaaataaaaacacaactattgattcagagaaaggaaaattgatcatgttagttaatgacttttattatggaaaacatgaaggagatgtccaggaggaacagaagactcacacaacctttaaatgcttcagttgcttgaaaattctaaaaaataacattaggtttatgaaccacatgaaacaccatttggaacttgagaagcagagcagtgagagctgggaaaaccataccacctgccagcactgctaccgtcagtttcccacaccatttcagttgcagtgtcacatcgaaagtacacatacgccccatgaattttctactatttgtaaaatctgtgaattgtcatttgaaacagaacatgttcttttacaacatatgaaggacaatcataaacctggtgaaatgccatatgtctgccaggtttgtaattatagatcatcatcattttctgatgtagaaactcattttagaacatcccatgaaaacactaagaacttgctatgcccgttttgcctcaaagttattaaaattgcaacaccatatatgcatcattatatgaagcatcagaaaaaaggaatacatcgttgtacaaaatgcaggctgcagtttttgacatgcaaggagaaaatggatcataagactcaacaccatcgaacatttataaaacctaaacaactagaaggattgcctcctggaacaaaagttactattcgagcttcagttggacctctgcaatcaggagcttcacctacaccttccattagtgcaagtgcttctacccttcagctctcacctccaaggactaaaaatataactgctaaaaatcctgcaaaatctaatacaagtaaacctaatacaatcaaatccaacgcaagtaaacctaatacaagtaagcctaatggaagtaaatctaaatacaaaccaaaaatctctaatatgcaaaagaaacaaagcacattggctagtagcaataaaaaaagtaaagtcaatacagcattgaggaatttaaggtatcgtcggggcattcacaaatgcattgagtgttgttccgaaataaaagattttgcaaaccactttcctacgtacgtccactgtagtttttgcagatacaacactagctgtagcaaagcctatgtaaatcatatgatgagctttcatagtaaccgtccaagcaaaaggttttgtatttttaagaagcattcagaaaatctccgatgcgtgggaggacaaatagaatgtgacttgcctaagttacacaagttggttgtggagccaagactgactctaggtcttctgactcctaacttttaacaattggtatgacaggggcattactctagtgtgccttaattgtgatttcctaagtgatgtttctggcttagataatatggctacacacttaagtcaacataaaactcatacttgccaagttgtaatgcagaaagtttctgtttgtatcccaacttctgagcacctttctgaattaaaaaaagaagctcccgcaaaggaacaagaacctgtgtctaaggaaattgcaagacctaacatggctgaaagagaaacagaaacatcaaattctgaaagtaaacaagataaagctgcttcttcaaaagaaaaaaatggatgtaatgcaaattcatttgaaggctcatcaacaacaaaaagtgaagaaagcataacagtttcagataaggaaaatgaaacctgtcttgcagaccaggaaactggctcaaaaaacatcgtcagttgtgattcaaatattggtgcagataaagtggaaaagaaaaaacaaatacaacacgtttgtcaggaaatggagttgaagatgtgccaaagttcagaaaacataatcttatctgatcagattaaagatcacaactccagtgaagccagattttcttcaaagaatattaaggatttgcgattagcatcagataatgtaagcattgatcagtttttgagaaaaagacatgaacctgaatctgttagttctgatgttagcgagcaaggcagtattcatttggaacctctgactccatccgaggtacttgagtatgaagccacagagattcttcagaaaggtagtggtgatccttcagccaagactgatgaagtagtgtctgatcaaacagatgacattcctggaggaaataaccctagcacaacagaggcaacagtagacctggaagatgaaaaagaaagaagttgaaattagtcattttaagtttcagtgtaccaacgataagggcatttggaacagtgctatcaggtgagctcagtggtgctgttgtaggttcagaaatggaaatatgtaagggaggtcacacatacactttacctgtatgttcaacctatgttatcaaacaaatcaattcaccaataatagcatgattagtagggattcccaaaaagtttttaaaaacacgaacaggattttaatgataattaaatttgcagtggaaaggtctcatttaatggttttcaaggaaatgggatttggttgctgacatgaattgatgatattagtaatatttataaagcctttcaaacttccatcaatcctaagctaaaaatctttattacctgtatatccttttcagttaactgagaggaagggatttggaaaccatgtacttttggggagtaattgattaaaaacaatggctgattggcattgttaatgaaggctttatttgtgaggatgatgctggtaaatggagcatgcttagagtactaaattgatctaatgagaatttggatgaacataaacttaattttggatttaatataacattccagtcagacgcatgtaaacagaatatttgaatctttgtacctccatacaagtgttagcctgccaggctgtaagcttaccttaattaaactttcagtgaaagtggaattattaagatataaatttatatttgtgctttttgtcagtgtgtaagctgtgtagaaattctttgatgtattagttgtattaatgtaaagtagaaacccattgttgaaactcctgtagctattatgcttttaatattgttttaatgatcttccttagaaataggcccataaaaatggtctggaagccaaaccaaagtatggtataatgtagatattgtaaagcagtaaactgaaaacatgtcctggcatgtattcagccatgtttaagtgacttttctgtaattgtaaaataaaaacttcaaatgggacctaaaacagtgatgtaaaagaactggttttggaaatttagcctaatttatctataagatggctgctaaattgatttttcagttctttttatcatctagaatataatagatatagaaatgaataatatgaagaacagtagtttgctttgaaatactaataaacttttatttaaaatgcttcatttttacttcttaaaatgtgctttggattcttaaattttgtttcactgaatgttcaatgttttaaatggcgattaaaatactctgctgtatatagtagtttttgagtaaatatttgcaataaaaatctgcccccgaa

SEQ ID NO: 369194 - DNA, 2670 bp, Homo sapiens
atttgacctcgacagggaacgcaagcaaaaccacacatttaaaacagacttggtaaaatcagctcgttatttaaagaaacggacgattcctttttctctcctggtttagtcttcgacccacaggccccttgcttctttcgaacggcggctgtatcccatgaccttttcactttccaagccaacggactgggggtcgttacacacgcggagggcccggaacgcacggctcctcgcctgcaaattccgagcagtccggattttggggctgcctcccggccacaccagccagcagctcgcacccacatggaggcagggccctggccctcgccccggaccggcgcgtggcggggcgcgtgggtcttcgagggcccgcgacgcggcgcacatgccggtgcccgcctcccgcgtcggcgagaagacagggagctcggacacggggaggctgacccggagcctacccatgaggcagcgcgccggctgcacgagagcccccccctttccacggctcggctgccagctccgcaatgggagccgccgccgtcgccgcagtgtagtttttcgtgctcctccttttcctcctcctctttctcctcctcctcagggctccagtcaggccgatccgctccgctcacggaaggaaaacagaaataacttgctggcttgtctggagtcacatgtacttaggtgacaatttacagaaagtcatctctgcagcttgatgggcgacaacccttttcaaccaaaaagtaattcaaaaatggcagaactgtttatggaatgtgaagaagaggagctggaaccatggcagaagaaagtaaaagaagttgaggatgacgatgatgatgagccaatctttgttggcgagatatcaagttcaaaaccagcaatttcaaatattttgaacagagttaaccccagctcatattcaaggggactaaagaatggtgcactcagtcgaggtattactgctgcattcaagcctacaagtcaacactacacgaatccaacatcaaatccagtgcctgcctcaccaataaattttcatcctgagtctagatcttcagatagttctgttattgttcagcctttttctaaacctgtaagtgtttctaaaactatacggccagctcagggatccattggatgttgtttatcaatatcaacagtacccagttacaattctggactgtcataagtagtcatccagtagaagcatagttagcatcagaaaatgtcaccatattttcgctagctcaagcagtaccccaagtaataactgaaggagctaactacccaacctgttaataacaggcagtatgcctaaataggtacagtaatgaaaactatactatcaaaatgtgaataaaattatagtcagccataaacattgcataatgacaaatatttaagattgcagacgggaccaggtattcttaattgggaaaacagtcaagtgaccatcatagctttttattctgaaaacattccttcatagttcagttagttaaaaaaaaacaaacattttttcctattacaaaaaactcccactttttttgttacaaaaagtaatagaaaatggtaatagttaacattcattgagctgttaatatgtataagtgtttgtgctaaatgctataggtaaattcatttcatttagttcttaaacatccccatgaagtaaacactattattatcctcattttttagttgaggaaactgaggctcatagaggttgaaagatttattcaagatcccaaagctggcagttgatggatctgggatttcaatccagcctaacccatagtttatatgtatatgcacacatacatacatatatgttgtgtataaatgtacacttttttagacatgaaagaattgccttagttgaacagttctcagattgtagtttgcaatcccctggggttccccaagaccctttcagaggtttgagggtcaacagtgttgtcattataatcaaagactgttttccttttccactgtgttggcatttgcactggtgatgctaaagtaatggtggataagctgctggtgccttagtgtgaatcaaggtagtgccaccaaagtgtacttgtagtttctgtattagtcacctgccgtgcactcacagtaaactacattactcaactgagtattacccagttatacccaatccctgatgaagtattaaaatgttattagttttattaactctctacacttgaatgtgtgttttttaaaatattctgtgtgatgacatgggtagtgtgcataaagtacctctgtgtctgaagtatgatagttgtcttgaggaaaagcacttgtgtgattgaattgtgaggtaaactacctgatttttttttgttgttacatgaaagaatgactgacaaatctttaaagtatttacaatatcactccagaaaagaaaacaaatcaaataaatattgactcaaaactctccaagtacatatcaaaatctcaggaagggaaaaaagagtctaaagaacaaaatataacactattttatttcagtcatgttagttcagtttccacagtttgaactgggtatagattaatatctaaaaccaaaaaatgaacatgtgtatagtgatgctgaaaaatgtgcattattttttatttatattttaggaataataaagttagttattaaag

SEQ ID NO: 369195 - DNA, 2849 bp, Homo sapiens
ccttcaggcgcccgatgtgagtggcgatccgctccggtcacggaacgcaatgagagaattactttgcgagggttgttctgaagttacatgtgtttgggtgacagctttacaggagataggtcactcgtgctgtcatgcttgactggtgggactaaccgcgttttcaatgcgaccagaagtaaacttgcatccaagtgaggaacgagactcgtgtactggcatatgtgacgtagaccaggagctgtggaacctaggtgccgaaggacacagtcagtggacacgttcgaggatgacgatgatgatgactcgttctcggttggcagagatatcaagttcaataaccagcaagttatcaagatattttgaacagagttaaccccagctcatattcaaggggactaaagaatggtgcactcagtcgaggtattactgctgcattcaagcctacaagtcaacactacacgaatccaacatcaaatccagtgcctgcctcaccaataaattttcatcctgagtctagatcttcagatagttctgttattgttcagcctttttctaaacctgtaagtgtttctaaaactatacggccagctcagggatccattggatgttgtttatcaatatcaacagtacccagttacaattctggactgtcataagtagtcatccagtagaagcatagttagcatcagaaaatgtcaccatattttcgctagctcaagcagtaccccaagtaataactgaaggagctaactacccaacctgttaataacaggcagtatgcctaaataggtacagtaatgaaaactatactatcaaaatgtgaataaaattatagtcagccataaacattgcataatgacaaatatttaagattgcagacgggaccaggtattcttaattgggaaaacagtcaagtgaccatcatagctttttattctgaaaacattccttcatagttcagttagttaaaaaaaaacaaacattttttcctattacaaaaaactcccactttttttgttacaaaaagtaatagaaaatggtaatagttaacattcattgagctgttaatatgtataagtgtttgtgctaaatgctataggtaaattcatttcatttagttcttaaacatccccatgaagtaaacactattattatcctcattttttagttgaggaaactgaggctcatagaggttgaaagatttattcaagatcccaaagctggcagttgatggatctgggatttcaatccagcctaacccatagtttatatgtatatgcacacatacatacatatatgttgtgtataaatgtacacttttttagacatgaaagaattgccttagttgaacagttctcagattgtagtttgcaatcccctggggttccccaagaccctttcagaggtttgagggtcaacagtgttgtcattataatcaaagactgttttccttttccactgtgttggcatttgcactggtgatgctaaagtaatggtggataagctgctggtgccttagtgtgaatcaaggtagtgccaccaaagtgtacttgtagtttctgtattagtcacctgccgtgcactcacagtaaactacattactcaactgagtattacccagttatacccaatccctgatgaagtattaaaatgttattagttttattaactctctacacttgaatgtgtgttttttaaaatattctgtgtgatgacatgggtagtgtgcataaagtacctctgtgtctgaagtatgatagttgtcttgaggaaaagcacttgtgtgattgaattgtgaggtaaactacctgatttttttttgttgttacatgaaagaatgactgacaaatctttaaagtatttacaatatcactccagaaaagaaaacaaatcaaataaatattgactcaaaactctccaagtacatatcaaaatctcaggaagggaaaaaagagtctaaagaacaaaatataacactattttatttcagtcatgttagttcagtttccacagtttgaactgggtatagattaatatctaaaaccaaaaaatgaacatgtgtatagtgatgctgaaaaatgtgcattattttttatttatattttaggaataataaagttagttattaaagaatttagtgattttgattgagtgagaggtgtgagctatatttgcttctttcctgtatgatatacatacattgtttccaatctcatttctattaaataactataggagagcccacagccttgttattttacatatcactatttagatatttgttatttatttatttgtgttggcctgaagtaaatgttacttttttacgatatttgaaggatagatttattttataaattaatagtttaaataagattttgccagcatttgaaatgatatttatttctgtgtatcaatattaccacaaacttacacagcttaaaacaacatacactctttatctcatgatctcacaatttctgtgggtcaggaatcaggtcatggcttaggtgggttttctgcttaaggatctcacaaggctgcattcaagatgtggtgcctgaagttgcagtttcatctgaaattctgttggggaagtatttgcttccaagttcacatggttgttggtagcattcagttccttaagggatgttggactgagaatctctgtatcttgttggcttttggctggctccttgccacgtaggtcttcccaataaggctgcttgcttcctcaaagctagcaggtgagagtgagtccttagcaagatgcccttacagtcttagggtaacataatcacgtacacaaaaatcatatatatcctgtcacctttgttgtgttctat

SEQ ID NO: 369196 - DNA, 1328 bp, Homo sapiens
gcacgagtcatctgaagccaccgactttcagtgtaccaacgataagggcatttggaacagtgctatcaggtgagctcagtggtgctgttgtaggttcagaaatggaaatatgtaagggaggtcacacatacactttacctgtatgttcaacctatgttatcaaacaaatcaattcaccaataatagcatgattagtagggattcccaaaaagtttttaaaaacacgaacaggattttaatgataattaaatttgcagtggaaaggtctcatttaatggttttcaaggaaatgggatttggttgctgacatgaattgatgatattagtaatatttataaagcctttcaaacttccatcaatcctaagctaaaaatctttattacctgtatatccttttcagttaactgagaggaagggatttggaaaccatgtacttttggggagtaattgattaaaaacaatggctgattggcattgttaatgaaggctttatttgtgaggatgatgctggtaaatggagcatgcttagagtactaaattgatctaatgagaatttggatgaacataaacttaattttggatttaatataacattccagtcagacgcatgtaaacagaatatttgaatctttgtacctccatacaagtgttagcctgccaggctgtaagcttaccttaattaaactttcagtgaaagtggaattattaagatataaatttatatttgtgctttttgtcagtgtgtaagctgtgtagaaattctttgatgtattagttgtattaatgtaaagtagaaacccattgttgaaactcctgtagctattatgcttttaatattgttttaatgatcttccttagaaataggcccataaaaatggtctggaagccaaaccaaagtatggtataatgtagatattgtaaagcagtaaactgaaaacatgtcctggcatgtattcagccatgtttaagtgacttttctgtaattgtaaaataaaaacttcaaatgggacctaaaacagtgatgtaaaagaactggttttggaaatttagcctaatttatctataagatggctgctaaattgatttttcagttctttttatcatctagaatataatagatatagaaatgaataatatgaagaacagtagtttgctttgaaatactaataaacttttatttaaaatgcttcatttttacttcttaaaatgtgctttggattcttaaattttgtttcactgaatgttcaatgttttaaatggcgattaaaatactctgctgtatatagtagtttttgagtaaatatttgcaataaaaatctgcccccgaa

SEQ ID NO: 369197 - DNA, 294 bp, Homo sapiens
ctttttggtgggcaaatgtaccttgactttttattttttagaacacgtctttattttgacagtgttcaaaaacattgctttatgaagaaatacataataaatgactttatttttcagtaaacaagataaagctgcttcttcaaaagaaaaaaatggatgtaatgcaaattcatttgaaggctcatcaacaacaaaaagtgaagaaagcataacagtttcagataaggaaaatgaaacctgtcttgcagaccaggaaactggctcaaaaaacatcgtcagttgtgattcaaatat

SEQ ID NO: 369198 - DNA, 446 bp, Homo sapiens
tgtctcaaagatggtcttttggtgttgccttagtgagattcttggttgcaaaggcatcagagctagattagtagtacataatgttctcctgacaaattatccatcattgttcctttgtaattgcatatcagttttaaattttcaagttaaactaagccttctttctttttttaggtttgtaattatagatcatcatcattttctgatgtagaaactcattttagaacatcccatgaaaacactaagaacttgctatgcccgttttgcctcaaagttattaaaattgcaacaccatatatgcatcattatatgaagcatcaggtgagatttaccagttcttatttgtttattatgttgtcttagtgaaaaaactgattatgacttggagaatctttagatttgttctgcaagagaagcagagttgttccaaatgacactattaattt

SEQ ID NO: 369199 - DNA, 1328 bp, Homo sapiens
atttgacctcgacagggaacgcaagcaaaaccacacatttaaaacagacttggtaaaatcagctcgttatttaaagaaacggacgattcctttttctctcctggtttagtcttcgacccacaggccccttgcttctttcgaacggcggctgtatcccatgaccttttcactttccaagccaacggactgggggtcgttacacacgcggagggcccggaacgcacggctcctcgcctgcaaattccgagcagtccggattttggggctgcctcccggccacaccagccagcagctcgcacccacatggaggcagggccctggccctcgccccggaccggcgcgtggcggggcgcgtgggtcttcgagggcccgcgacgcggcgcacatgccggtgcccgcctcccgcgtcggcgagaagacagggagctcggacacggggaggctgacccggagcctacccatgaggcagcgcgccggctgcacgagagcccccccctttccacggctcggctgccagctccgcaatgggagccgccgccgtcgccgcagtgtagtttttcgtgctcctccttttcctcctcctctttctcctcctcctcagggctccagtcaggccgatccgctccgctcacgtcgtaggaaaggagaccaaaggggattcgggatttgcaggcacagggcccctcattttgcccagatgaccggtcgttccacgtttgcaccctcatttttgtcaaagagacctcccctcctctgccatagaattcccgttattgtctacagaagaagggccctgaggagaaacgtggagttggagacaaaattttctgagctttgcaaggttcacttactgagacggaaagaatgatctcactctgaggttttagcctgctccagcgatggaaggaattcctcccaacttatctcaagttttaacgcttttaaggagaaatctgctggagaggaaaaacgtcaaggtgaacccgcttctgcaagcacgggagacctttggccaaaggcctttgtttgcgaagatttgttaaaaaaaaaaaaatctgtcatcttaaatatttggctttattttcaggtttggacagaatttgtcttttttagtgccatgaaacataaaatggaacgctagaaggacagttttaaagcacaaaagctgcctcttagcatctgtaaggtgtcctgctttgggggactgctgtgccaactccagctgtctccacgcagaaacttaaccagggaaggcactggtttgcttataccattgttagggctgtgtgcctctgatgttttaacatcactacaaatactgttgtaaa

SEQ ID NO: 369200 - DNA, 4923 bp, Homo sapiens
atttgacctcgacagggaacgcaagcaaaaccacacatttaaaacagacttggtaaaatcagctcgttatttaaagaaacggacgattcctttttctctcctggtttagtcttcgacccacaggccccttgcttctttcgaacggcggctgtatcccatgaccttttcactttccaagccaacggactgggggtcgttacacacgcggagggcccggaacgcacggctcctcgcctgcaaattccgagcagtccggattttggggctgcctcccggccacaccagccagcagctcgcacccacatggaggcagggccctggccctcgccccggaccggcgcgtggcggggcgcgtgggtcttcgagggcccgcgacgcggcgcacatgccggtgcccgcctcccgcgtcggcgagaagacagggagctcggacacggggaggctgacccggagcctacccatgaggcagcgcgccggctgcacgagagcccccccctttccacggctcggctgccagctccgcaatgggagccgccgccgtcgccgcagtgtagtttttcgtgctcctccttttcctcctcctctttctcctcctcctcagggctccagtcaggccgatccgctccgctcacggaaggaaaacagaaataacttgctggcttgtctggagtcacatgtacttaggtgacaatttacagaaagtcatctctgcagcttgatgggcgacaacccttttcaaccaaaaagtaattcaaaaatggcagaactgtttatggaatgtgaagaagaggagctggaaccatggcagaagaaagtaaaagaagttgaggatgacgatgatgatgagccaatctttgttggcgagatatcaagttcaaaaccagcaatttcaaatattttgaacagagttaaccccagctcatattcaaggggactaaagaatggtgcactcagtcgaggtattactgctgcattcaagcctacaagtcaacactacacgaatccaacatcaaatccagtgcctgcctcaccaataaattttcatcctgagtctagatcttcagatagttctgttattgttcagcctttttctaaacctggttatataacaaactcatcacgagttgtgtctaataagtcatcagagttactgtttgacttgacccaggatacaggattatcacattaccaagggggaccaacactttctatggcaggtatgagtgaaagttcatttttatcaaaacgtccttctacttctgaagtaaataatgttaatccaaagaagcctaaacccagcgaaagtgtttctggagcaaattcctcagctgtattaccttcagttaaatctccttcagtgacttcttcccaggctatgctagcaaaaggtacaaatacctcatcaaatcagtctaaaaatggaacaccttttccaagagcttgtccaaagtgcaacattcatttcaatcttttggatcctttgaaaaatcacatgaagtattgttgtccagacatgataaataactttttgggactggctaaaacagaattttcaagtacagtaaataaaaacacaactattgattcagagaaaggaaaattgatcatgttagttaatgacttttattatggaaaacatgaaggagatgtccaggaggaacagaagactcacacaacctttaaatgcttcagttgcttgaaaattctaaaaaataacattaggtttatgaaccacatgaaacaccatttggaacttgagaagcagagcagtgagagctgggaaaaccataccacctgccagcactgctaccgtcagtttcccacaccatttcagttgcagtgtcacatcgaaagtacacatacgccccatgaattttctactatttgtaaaatctgtgaattgtcatttgaaacagaacatgttcttttacaacatatgaaggacaatcataaacctggtgaaatgccatatgtctgccaggtttgtaattatagatcatcatcattttctgatgtagaaactcattttagaacatcccatgaaaacactaagaacttgctatgcccgttttgcctcaaagttattaaaattgcaacaccatatatgcatcattatatgaagcatcagaaaaaaggaatacatcgttgtacaaaatgcaggctgcagtttttgacatgcaaggagaaaatggatcataagactcaacaccatcgaacatttataaaacctaaacaactagaaggattgcctcctggaacaaaagttactattcgagcttcagttggacctctgcaatcaggagcttcacctacaccttccattagtgcaagtgcttctacccttcagctctcacctccaaggactaaaaatataactgctaaaaatcctgcaaaatctaatacaagtaaacctaatacaatcaaatccaacgcaagtaaacctaatacaagtaagcctaatggaagtaaatctaaatacaaaccaaaaatctctaatatgcaaaagaaacaaagcacattggctagtagcaataaaaaaagtaaagtcaatacagcattgaggaatttaaggtatcgtcggggcattcacaaatgcattgagtgttgttccgaaataaaagattttgcaaaccactttcctacgtacgtccactgtagtttttgcagatacaacactagctgtagcaaagcctatgtaaatcatatgatgagctttcatagtaaccgtccaagcaaaaggttttgtatttttaagaagcattcagaaaatctccggggcattactctagtgtgccttaattgtgatttcctaagtgatgtttctggcttagataatatggctacacacttaagtcaacataaaactcatacttgccaagttgtaatgcagaaagtttctgtttgtatcccaacttctgagcacctttctgaattaaaaaaagaagctcccgcaaaggaacaagaacctgtgtctaaggaaattgcaagacctaacatggctgaaagagaaacagaaacatcaaattctgaaagtaaacaagataaagctgcttcttcaaaagaaaaaaatggatgtaatgcaaattcatttgaaggctcatcaacaacaaaaagtgaagaaagcataacagtttcagataaggaaaatgaaacctgtcttgcagaccaggaaactggctcaaaaaacatcgtcagttgtgattcaaatattggtgcagataaagtggaaaagaaaaaacaaatacaacacgtttgtcaggaaatggagttgaagatgtgccaaagttcattttcttcaaagaatattaaggatttgcgattagcatcagataatgtaagcattgatcagtttttgagaaaaagacatgaacctgaatctgttagttctgatgttagcgagcaaggcagtattcatttggaacctctgactccatccgaggtacttgagtatgaagccacagagattcttcagaaaggtagtggtgatccttcagccaagactgatgaagtagtgtctgatcaaacagatgacattcctggaggaaataaccctagcacaacagaggcaacagtagacctggaagatgaaaaagaaagaagttgaaattagtcattttaagtttcagtgtaccaacgataagggcatttggaacagtgctatcaggtgagctcagtggtgctgttgtaggttcagaaatggaaatatgtaagggaggtcacacatacactttacctgtatgttcaacctatgttatcaaacaaatcaattcaccaataatagcatgattagtagggattcccaaaaagtttttaaaaacacgaacaggattttaatgataattaaatttgcagtggaaaggtctcatttaatggttttcaaggaaatgggatttggttgctgacatgaattgatgatattagtaatatttataaagcctttcaaacttccatcaatcctaagctaaaaatctttattacctgtatatccttttcagttaactgagaggaagggatttggaaaccatgtacttttggggagtaattgattaaaaacaatggctgattggcattgttaatgaaggctttatttgtgaggatgatgctggtaaatggagcatgcttagagtactaaattgatctaatgagaatttggatgaacataaacttaattttggatttaatataacattccagtcagacgcatgtaaacagaatatttgaatctttgtacctccatacaagtgttagcctgccaggctgtaagcttaccttaattaaactttcagtgaaagtggaattattaagatataaatttatatttgtgctttttgtcagtgtgtaagctgtgtagaaattctttgatgtattagttgtattaatgtaaagtagaaacccattgttgaaactcctgtagctattatgcttttaatattgttttaatgatcttccttagaaataggcccataaaaatggtctggaagccaaaccaaagtatggtataatgtagatattgtaaagcagtaaactgaaaacatgtcctggcatgtattcagccatgtttaagtgacttttctgtaattgtaaaataaaaacttcaaatgggacctaaaacagtgatgtaaaagaactggttttggaaatttagcctaatttatctataagatggctgctaaattgatttttcagttctttttatcatctagaatataatagatatagaaatgaataatatgaagaacagtagtttgctttgaaatactaataaacttttatttaaaatgcttcatttttacttcttaaaatgtgctttggattcttaaattttgtttcactgaatgttcaatgttttaaatggcgattaaaatactctgctgtatatagtagtttttgagtaaatatttgcaataaaaatctgcccccgaa

SEQ ID NO: 369201 - DNA, 3385 bp, Homo sapiens
atttgacctcgacagggaacgcaagcaaaaccacacatttaaaacagacttggtaaaatcagctcgttatttaaagaaacggacgattcctttttctctcctggtttagtcttcgacccacaggccccttgcttctttcgaacggcggctgtatcccatgaccttttcactttccaagccaacggactgggggtcgttacacacgcggagggcccggaacgcacggctcctcgcctgcaaattccgagcagtccggattttggggctgcctcccggccacaccagccagcagctcgcacccacatggaggcagggccctggccctcgccccggaccggcgcgtggcggggcgcgtgggtcttcgagggcccgcgacgcggcgcacatgccggtgcccgcctcccgcgtcggcgagaagacagggagctcggacacggggaggctgacccggagcctacccatgaggcagcgcgccggctgcacgagagcccccccctttccacggctcggctgccagctccgcaatgggagccgccgccgtcgccgcagtgtagtttttcgtgctcctccttttcctcctcctctttctcctcctcctcagggctccagtcaggccgatccgctccgctcacggaaggaaaacagaaataacttgctggcttgtctggagtcacatgtacttaggtgacaatttacagaaagtcatctctgcagcttgatgggcgacaacccttttcaaccaaaaagtaattcaaaaatggcagaactgtttatggaatgtgaagaagaggagctggaaccatggcagaagaaagtaaaagaagttgaggatgacgatgatgatgagccaatctttgttggcgagatatcaagttcaaaaccagcaatttcaaatattttgaacagagttaaccccagctcatattcaaggggactaaagaatggtgcactcagtcgaggtattactgctgcattcaagcctacaagtcaacactacacgaatccaacatcaaatccagtgcctgcctcaccaataaattttcatcctgagtctagatcttcagatagttctgttattgttcagcctttttctaaacctgtaagtgtttctaaaactatacggccagctcagggatccattggatgttgtttatcaatatcaacagtacccagttacaattctggactgtcataagtagtcatccagtagaagcatagttagcatcagaaaatgtcaccatattttcgctagctcaagcagtaccccaagtaataactgaaggagctaactacccaacctgttaataacaggcagtatgcctaaataggtacagtaatgaaaactatactatcaaaatgtgaataaaattatagtcagccataaacattgcataatgacaaatatttaagattgcagacgggaccaggtattcttaattgggaaaacagtcaagtgaccatcatagctttttattctgaaaacattccttcatagttcagttagttaaaaaaaaacaaacattttttcctattacaaaaaactcccactttttttgttacaaaaagtaatagaaaatggtaatagttaacattcattgagctgttaatatgtataagtgtttgtgctaaatgctataggtaaattcatttcatttagttcttaaacatccccatgaagtaaacactattattatcctcattttttagttgaggaaactgaggctcatagaggttgaaagatttattcaagatcccaaagctggcagttgatggatctgggatttcaatccagcctaacccatagtttatatgtatatgcacacatacatacatatatgttgtgtataaatgtacacttttttagacatgaaagaattgccttagttgaacagttctcagattgtagtttgcaatcccctggggttccccaagaccctttcagaggtttgagggtcaacagtgttgtcattataatcaaagactgttttccttttccactgtgttggcatttgcactggtgatgctaaagtaatggtggataagctgctggtgccttagtgtgaatcaaggtagtgccaccaaagtgtacttgtagtttctgtattagtcacctgccgtgcactcacagtaaactacattactcaactgagtattacccagttatacccaatccctgatgaagtattaaaatgttattagttttattaactctctacacttgaatgtgtgttttttaaaatattctgtgtgatgacatgggtagtgtgcataaagtacctctgtgtctgaagtatgatagttgtcttgaggaaaagcacttgtgtgattgaattgtgaggtaaactacctgatttttttttgttgttacatgaaagaatgactgacaaatctttaaagtatttacaatatcactccagaaaagaaaacaaatcaaataaatattgactcaaaactctccaagtacatatcaaaatctcaggaagggaaaaaagagtctaaagaacaaaatataacactattttatttcagtcatgttagttcagtttccacagtttgaactgggtatagattaatatctaaaaccaaaaaatgaacatgtgtatagtgatgctgaaaaatgtgcattattttttatttatattttaggaataataaagttagttattaaagaatttagtgattttgattgagtgagaggtgtgagctatatttgcttctttcctgtatgatatacatacattgtttccaatctcatttctattaaataactataggagagcccacagccttgttattttacatatcactatttagatatttgttatttatttatttgtgttggcctgaagtaaatgttacttttttacgatatttgaaggatagatttattttataaattaatagtttaaataagattttgccagcatttgaaatgatatttatttctgtgtatcaatattaccacaaacttacacagcttaaaacaacatacactctttatctcatgatctcacaatttctgtgggtcaggaatcaggtcatggcttaggtgggttttctgcttaaggatctcacaaggctgcattcaagatgtggtgcctgaagttgcagtttcatctgaaattctgttggggaagtatttgcttccaagttcacatggttgttggtagcattcagttccttaagggatgttggactgagaatctctgtatcttgttggcttttggctggctccttgccacgtaggtcttcccaataaggctgcttgcttcctcaaagctagcaggtgagagtgagtccttagcaagatgcccttacagtcttagggtaacataatcacgtacacaaaaatcatatatatcctgtcacctttgttgtgttctat

SEQ ID NO: 369202 - DNA, 2193 bp, Homo sapiens
acagaggtcaatttactattaaagtataaaatgtacattagtttcgatctacattttaattattttaggctggcagagaaagaactgtttcatattttaccatcgtacatataaaataaaatattcaatacttatcttgttttcaagattaaaaaaagaagctcccgcaaaggaacaagaacctgtgtctaaggaaattgcaagacctaacatggctgaaagagaaacagaaacatcaaattctgaaagtaaacaagataaagctgcttcttcaaaagaaaaaaatggatgtaatgcaaattcatttgaaggctcatcaacaacaaaaagtgaagaaagcataacagtttcagataaggaaaatgaaacctgtcttgcagaccaggaaactggctcaaaaaacatcgtcagttgtgattcaaatattggtgcagataaagtggaaaagaaaaaacaaatacaacacgtttgtcaggaaatggagttgaagatgtgccaaagttcagaaaacataatcttatctgatcagattaaagatcacaactccagtgaagccagattttcttcaaagaatattaaggatttgcgattagcatcagataatgtaagcattgatcagtttttgagaaaaagacatgaacctgaatctgttagttctgatgttagcgagcaaggcagtattcatttggaacctctgactccatccgaggtacttgagtatgaagccacagagattcttcagaaaggtagtggtgatccttcagccaagactgatgaagtagtgtctgatcaaacagatgacattcctggaggaaataaccctagcacaacagaggcaacagtagacctggaagatgaaaaagaaagaagttgaaattagtcattttaagtttcagtgtaccaacgataagggcatttggaacagtgctatcaggtgagctcagtggtgctgttgtaggttcagaaatggaaatatgtaagggaggtcacacatacactttacctgtatgttcaacctatgttatcaaacaaatcaattcaccaataatagcatgattagtagggattcccaaaaagtttttaaaaacacgaacaggattttaatgataattaaatttgcagtggaaaggtctcatttaatggttttcaaggaaatgggatttggttgctgacatgaattgatgatattagtaatatttataaagcctttcaaacttccatcaatcctaagctaaaaatctttattacctgtatatccttttcagttaactgagaggaagggatttggaaaccatgtacttttggggagtaattgattaaaaacaatggctgattggcattgttaatgaaggctttatttgtgaggatgatgctggtaaatggagcatgcttagagtactaaattgatctaatgagaatttggatgaacataaacttaattttggatttaatataacattccagtcagacgcatgtaaacagaatatttgaatctttgtacctccatacaagtgttagcctgccaggctgtaagcttaccttaattaaactttcagtgaaagtggaattattaagatataaatttatatttgtgctttttgtcagtgtgtaagctgtgtagaaattctttgatgtattagttgtattaatgtaaagtagaaacccattgttgaaactcctgtagctattatgcttttaatattgttttaatgatcttccttagaaataggcccataaaaatggtctggaagccaaaccaaagtatggtataatgtagatattgtaaagcagtaaactgaaaacatgtcctggcatgtattcagccatgtttaagtgacttttctgtaattgtaaaataaaaacttcaaatgggacctaaaacagtgatgtaaaagaactggttttggaaatttagcctaatttatctataagatggctgctaaattgatttttcagttctttttatcatctagaatataatagatatagaaatgaataatatgaagaacagtagtttgctttgaaatactaataaacttttatttaaaatgcttcatttttacttcttaaaatgtgctttggattcttaaattttgtttcactgaatgttcaatgttttaaatggcgattaaaatactctgctgtatatagtagtttttgagtaaatatttgcaataaaaatctgcccccgaa

SEQ ID NO: 369203 - DNA, 398 bp, Homo sapiens
tcacgcctgtaattccagcactttgggaggccgaggcgggtggatcactttaggtcagaagttcaagactagcctggccaacatggtgaaaccctttctctaccaaaaaaatacaaaaactagccgggtgtggtggtacatgcttgtagtcccagctattcgagcctgggtgacacggcaaaaccctagctccaaaaaaacatttttttaaaaaagaagccaggcctggtagtgcacgcctgtagtcccagctactcaggtgggtaaagtaagaggatggcttgagcctgggagttcaaggttgcaatgaaacatgattgcaccactgtactctagtctgggtgacagagtgagaccctgtctcacactctgtccccaaccccccctccaaaaaaaaa

SEQ ID NO: 369204 - DNA, 311 bp, Homo sapiens
tggaactttgatttattttatttactctagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcaagtctcattaacaatgcatttcagctcgtcaggtaatacacgctgcacaaagtcgcggtttatttctgaaagcagctgttattgttcaaattcttgatttctaaagacaaaaatgatcgattgataaca

SEQ ID NO: 369205 - DNA, 4986 bp, Homo sapiens
accaattcccttcctgggagttgcggcttccctcgctcggccccactcccgtttaccctttccccagctcccgccttagccaggggcttccccgcctgccgctagggctcgggccgaagcgccgctcagcgccagcctgccgctccccgggctccactttcactttcggtcctgggggagctaggccggcggcagtggtggtggcggcggcgcaagggtgagggcggccccagaaccccaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccgtcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagataaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggctcaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacaccctgtgtctacacctgtggaaaatcctgctcagatccgggagatgtttgatgatgtttcttatgataagggagcttgtattctgaatatgctaagggagtatcttagtgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaagggttttcccctaataaccatcacagtgagggggaggaatgtacacatgaagcaagagcactacatgaagggctctgacggcgccccggacactgggtacctgtggcatgttccattgacattcatcaccagcaaatccgacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcaagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcgaatgctgcggagtcaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggctactagatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacgtatgtaaaaattcctcccttgccaggttcctgttatctctaatcaccaacattttgttgagtgtattttcaaactagagatggctgttttggctccaactggagatacttttttcccttcaactcattttttgactatccctgtgaaaagaatagctgttagtttttcatgaatgggctatcgctaccatgtgttttgttcatcacaggtgttgccctgcaacgtaaacccaagtgttgggttccctgccacagaagaataaagtaccttattcttctcattttatagtttatgcttaagcacccgtgtccaaaaccctgtaccccatgtttatcattcataaactgtttcatcagtctcctcgaaagactctgaatagtcgactactgaacaatgaacacctggatctgagactaagccggacgatgactgggttaaagctctcccggctcacccctccagacccgctgcccatccctcttccttgctccatgcccaggggctgacttgtaaaggccaagtcatcaagctttcttgccctttggatgttggtcagtggggagccggagagctggagctggggtcggaggaggtagtaggtggaggtgttcttccctgattcccttgcgggatgcctcgggctggcctcccctgagggtcttagctccgagaggggaccctcttttccacacagccttctccacctctggattttggtaactgctccctcctcatcccttcaggattagtggcctcagtgggagtctggcttttactagtcctggcggacttgtggtttctacataatgtgctcgcacttttgcaaaaaatctttttatagaaccctcctcagataattctgagtgtcatctatttccctgactggtacagtatctcttctgaaaaagcagagtgcattcaagtctgtaggaaaacccttttcttagggaggtgattttttttctctctctgcttcttatttggcctactttacaatttctaactaactagttattggcatttactgacagtaaattattgcagtcaccaataaatgatagtacattgtgaaacaaaatatttgctcatattagcaaataggacattctttggctttgaagtctttcttttgtgaagacttcacacacggttgcttcagcacacagttgctgctcaggttttatgtatagatgataataatagaaagcacagtttactaacatggtaaaccaacggagttcaagtcaagtcagttaataccctaagaattagattttatttcttattctgaaaacttgctacacagggacttatctaacccatagtgtgctctgttgctgacttgattcaagttgcagcgtgttttgcgctgactctaaggtgcggaaatcctcacacctggcaaaggagaattcaaactgaactttttgaatataaggcaaaaacttcaagataagggaatatgattgatgattggtacgaaaaatgtcaaaatgtgttcccctaatacacgacaaaatagagtgacttctggacataaatctgccatttattaaaccattcactacaacaaataaataggtataaaagtggaattggaatttttatacttatttgttgtagtgaatggtttaataaaaatagaaatcactggtaatttccaccccaaactaaactatttcccttcttttaaaaaaatacacaaccaagattttaatgtaaaatattttgctttaattgtattttatgccttgattaatgaaacatggaaatattgattttcagttttggtcacctgaggaacctatctttgtttgcttttggaaaagcccattttctaaacagatacaatattgccacaacaatgtgcagaaacctttttgataataaaaaattgttctttgcctct

SEQ ID NO: 369206 - DNA, 475 bp, Homo sapiens
ccaagtgtttcctcagcttttctgcaccttcctctccattgacctagagtgtctatggaacactcagagtgtcccctgtgtaaaccacctaccacaagattatcaacttcaggcaatggaccacgcaccaggattccacctctttctagcacctatcagtgttgcgcacatcataggccctcaacaaacagtgtgagagaaacctgtgacttgcttctaacccataggatatggcaaggaactagtcatatctgagagcagcctccagaaaacagtcagcaaaacactgaggttctcaatccgatagtcaatgaggaacggaatgctggaacaatgatgtgagcttggaagcagatccttcccttctgctgggcctcaggtgagactgcagctccagtcatcatcttgattgcagcccacagaaactaccaacccacagaaactgtgagttaataaatgtgttgttttaaaatga

SEQ ID NO: 369207 - DNA, 6765 bp, Homo sapiens
  misc_feature (5820)..(5820): n is a, c, g, or t
accaattcccttcctgggagttgcggcttccctcgctcggccccactcccgtttaccctttccccagctcccgccttagccaggggcttccccgcctgccgctagggctcgggccgaagcgccgctcagcgccagcctgccgctccccgggctccactttcactttcggtcctgggggagctaggccggcggcagtggtggtggcggcggcgcaagggtgagggcggccccagaaccccaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccgtcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagataaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggctcaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacaccctgtgtctacacctgtggaaaatcctgctcagatccgggagatgtttgatgatgtttcttatgataagggagcttgtattctgaatatgctaagggagtatcttagtgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaagggttttcccctaataaccatcacagtgagggggaggaatgtacacatgaagcaagagcactacatgaagggctctgacggcgccccggacactgggtacctgtggcatgttccattgacattcatcaccagcaaatccgacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcaagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcgaatgctgcggagtcaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggctactagatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacatgatcctgaagctgacgcaacaggatgaaaatccatcagaatctcagactacagcactaaatatgctttgatgctacatcaaacggaatggaagcatagctgacttcgctaaagttacttcatctccatctagcaaatgaggcactgttctcaaccaaaggagatggggatctggtttagggcaatccctttataatttgatgtgctgtggtctccttggtaatgtataatttggtattgcacaggtgattagtcaaggaagtctggaaaagctttggtcccacagccttgcctcacagcatgtaaataattaaaacaatattgatgctgaggttcttctactgctagtatgaaagtgacaaatttttactggtgtgaattgggaagaaaacaatgctattccatgacgtttgtaaaatgtttgtaaaagctcaaacatgacgattccataaaataaacttgaggttaaataatgggtagtaaattatagaatgtataagaaaaaatataaaggagaaaatcaattatcaggaaagctaaagaacttttcaaatctagtaatttgaatatagacacaatgcactttattgcactttcaattcttataaagcaacaataatattaaggtccttgactatgtgtacaatgttttcacatatatagtttcatttaatcatttcaaagttaatctctgccatctcgctaaatcatcagtctcggctcttctgaaatagaaggtgcctgatcttcctaataattctgcctattttcatttgctttaaacaggcgccctattttctttctagttgtggctgcgcaaaaacatttatctcccaaataagatgtgctgcttaccgaggtatcacggggtggggctccagcttgggtcgttgaagctggggtttgggaaaccacttcagagatggcagcagcaagtttagcatcttcaaatttcttttattgaaaaaaattttattagtaacatgttgtatataaaattatgagcacaatgccatcacttaactataactcttaaagatagcttaatgactgtttattctcttgaccaaatagactcataataacatataattttaaaagaaatttaaattctttcttctctattgtattattttatacaatttgctatttctatttccttctcatattgattattctaaatactatgcaataatataacttagagttccacggtttgtttacacatttcctgttgtacatttaggttattcaaagttttcagctcttttaaaattgctctgaataagttctagtgagtgagttatggtgctggctatattttgctaaactgccctctcaaatgttgctaggaattcatactgcgaaaagcaatgaataagcatgcctgttttcccatggccttgcttgccagaatttgacttttattatgataatcagtgtaaaatgatatactactattgcttgtatattgtggtatacggtgtcaggtttcagggttttttttcaacgttaaatattctagaaactttctgaaataatttctgtttaaaaatattgaatatttgcttcatttcaaatactcccttttgacaaaaaaacttaggtataactgttgatgaaaaaccagaaaaaagtccagaactctttggtgactccaactatggatagcttattttgaaaaaggagaattgcaaattttaccaaaagatggagaaaagcacattaaaaagataccaacattcagaaattcatttcagcatgttattattggaaattatttaaactaatttagataactataagatacttattgtccatttataccctgtaaagccgttttagaatgtaatattttaggtaatccaaaatgtactaaattaaattcatttttagttatgagaaatctttgcttatatgacaaatgaaaagaataacaagttgtcaaatgaaaagaatgacattgaaacatttgtattgtctcttcttaaactatcttattgacttattatttaagccttttaatactaagtatgaaacaacctatggtctggaaatttgtatcgcaaagctatatgtgcatatgttatttaattcatctaacgctacacaaaagcataaaataatgatttttcactctctttaaaaatactaaatcatttatgtccatttctcaattttttcattgatctatgctttgagtttgctttctcaacattattgtattttccacttattattactgtataacatatgctagtgtttagttggattaatcttacctaaaagtactgaaaaatgctttttagtactttttcatattttatacatttattttccgaatgtatcattgaataattttattgagttataaaagtatcttattgctatttaataaaaaattaacacataaaatgacttgaattgtcatcattctttttaagatatttagttaaactgacttaatgtatggccttcaatttttttgtgtccttatttttctgatcatttctccttttatagtttacattaagtctgatctcatattaattacattttctcatctgttgttactaataaacatggcataatgttacttacaaatgtattatctacaagtagtgctatccacaaatatattcaaatgttcccttttaatgtttgtcatttttttcatgtgttgttaatgattcttccatgtgataataagcagaaatgacaataaacttttcatagtttctgnttttaaggaaaatgcctccagcatgatattgaatatttgattctgaaaactaaagactctttaacagattaggggattgcctactttttaaaaagtttttatttataatatgagtatatgtaaaattttaaatagatcttttacatggacatgattatttgtttctatttgatataccactacaatatattgacagttttcctgctactgaatcaatacttataatggcaaataatttaactgtttgttatattctatgtatgctgtatgtaatttttacatctacacatttaagtaactttagctgataccgttatatttgtcagattttaagattagcaccataattactcatagaagcaactatgtgaccccatctttttcatgacatatttatgccacataagaactgagtgttcaacagttagagtcatctttaaaccttcagtagaaggacagtttgaaaatcattgcaatattttcttcagtctttttttaggttttgtgaattacgcagtttaatatttttgtttaatcttagaaaattgttgtacatagtgtttcctaataatttatttgtgctctgtactgattattgtattttctcacatttatgttaaattttattagtaagattattttctctatttatcagttttgtaaaatgttaaaaattcataaaagccaactgactattggctttaaactaccaataatttagttgatctctatattattatattactctgttaaaatttaattgtattttttgtaaggttttttttcctcttttatatttgctagtattttataaagtatttgttatttcaaaagaaacaactattggccagttaactttcatgccgctattttcatttcctggtatgcttattgctactttgtttttggtggctaccttattaaaacttttagaaatttcagttt

SEQ ID NO: 369208 - DNA, 6968 bp, Homo sapiens
  misc_feature (6023)..(6023): n is a, c, g, or t
ccaagtgtttcctcagcttttctgcaccttcctctccattgacctagagtgtctatggaacactcagagtgtcccctgtgtaaaccacctaccacaagattatcaacttcaggcaatggaccacgcaccaggattccacctctttctagcacctatcagtgttgcgcacatcataggccctcaacaaacagtgtgagagaaacctgtgacttgcttctaacccataggatatggcaaggaactagtcatatctgagagcagcctccagaaaacagtcagcaaaacactgaggttctcaatccgatagtcaatgaggaacggaatgctggaacaatgatgtgagcttggaagcagatccttcccttctgctgggcctcaggtgagactgcagctccagtcatcatcttgattgcagcccacagaaactaccaacccacagaaactgtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccgtcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagataaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggctcaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacaccctgtgtctacacctgtggaaaatcctgctcagatccgggagatgtttgatgatgtttcttatgataagggagcttgtattctgaatatgctaagggagtatcttagtgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaagggttttcccctaataaccatcacagtgagggggaggaatgtacacatgaagcaagagcactacatgaagggctctgacggcgccccggacactgggtacctgtggcatgttccattgacattcatcaccagcaaatccgacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcaagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcgaatgctgcggagtcaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggctactagatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacatgatcctgaagctgacgcaacaggatgaaaatccatcagaatctcagactacagcactaaatatgctttgatgctacatcaaacggaatggaagcatagctgacttcgctaaagttacttcatctccatctagcaaatgaggcactgttctcaaccaaaggagatggggatctggtttagggcaatccctttataatttgatgtgctgtggtctccttggtaatgtataatttggtattgcacaggtgattagtcaaggaagtctggaaaagctttggtcccacagccttgcctcacagcatgtaaataattaaaacaatattgatgctgaggttcttctactgctagtatgaaagtgacaaatttttactggtgtgaattgggaagaaaacaatgctattccatgacgtttgtaaaatgtttgtaaaagctcaaacatgacgattccataaaataaacttgaggttaaataatgggtagtaaattatagaatgtataagaaaaaatataaaggagaaaatcaattatcaggaaagctaaagaacttttcaaatctagtaatttgaatatagacacaatgcactttattgcactttcaattcttataaagcaacaataatattaaggtccttgactatgtgtacaatgttttcacatatatagtttcatttaatcatttcaaagttaatctctgccatctcgctaaatcatcagtctcggctcttctgaaatagaaggtgcctgatcttcctaataattctgcctattttcatttgctttaaacaggcgccctattttctttctagttgtggctgcgcaaaaacatttatctcccaaataagatgtgctgcttaccgaggtatcacggggtggggctccagcttgggtcgttgaagctggggtttgggaaaccacttcagagatggcagcagcaagtttagcatcttcaaatttcttttattgaaaaaaattttattagtaacatgttgtatataaaattatgagcacaatgccatcacttaactataactcttaaagatagcttaatgactgtttattctcttgaccaaatagactcataataacatataattttaaaagaaatttaaattctttcttctctattgtattattttatacaatttgctatttctatttccttctcatattgattattctaaatactatgcaataatataacttagagttccacggtttgtttacacatttcctgttgtacatttaggttattcaaagttttcagctcttttaaaattgctctgaataagttctagtgagtgagttatggtgctggctatattttgctaaactgccctctcaaatgttgctaggaattcatactgcgaaaagcaatgaataagcatgcctgttttcccatggccttgcttgccagaatttgacttttattatgataatcagtgtaaaatgatatactactattgcttgtatattgtggtatacggtgtcaggtttcagggttttttttcaacgttaaatattctagaaactttctgaaataatttctgtttaaaaatattgaatatttgcttcatttcaaatactcccttttgacaaaaaaacttaggtataactgttgatgaaaaaccagaaaaaagtccagaactctttggtgactccaactatggatagcttattttgaaaaaggagaattgcaaattttaccaaaagatggagaaaagcacattaaaaagataccaacattcagaaattcatttcagcatgttattattggaaattatttaaactaatttagataactataagatacttattgtccatttataccctgtaaagccgttttagaatgtaatattttaggtaatccaaaatgtactaaattaaattcatttttagttatgagaaatctttgcttatatgacaaatgaaaagaataacaagttgtcaaatgaaaagaatgacattgaaacatttgtattgtctcttcttaaactatcttattgacttattatttaagccttttaatactaagtatgaaacaacctatggtctggaaatttgtatcgcaaagctatatgtgcatatgttatttaattcatctaacgctacacaaaagcataaaataatgatttttcactctctttaaaaatactaaatcatttatgtccatttctcaattttttcattgatctatgctttgagtttgctttctcaacattattgtattttccacttattattactgtataacatatgctagtgtttagttggattaatcttacctaaaagtactgaaaaatgctttttagtactttttcatattttatacatttattttccgaatgtatcattgaataattttattgagttataaaagtatcttattgctatttaataaaaaattaacacataaaatgacttgaattgtcatcattctttttaagatatttagttaaactgacttaatgtatggccttcaatttttttgtgtccttatttttctgatcatttctccttttatagtttacattaagtctgatctcatattaattacattttctcatctgttgttactaataaacatggcataatgttacttacaaatgtattatctacaagtagtgctatccacaaatatattcaaatgttcccttttaatgtttgtcatttttttcatgtgttgttaatgattcttccatgtgataataagcagaaatgacaataaacttttcatagtttctgnttttaaggaaaatgcctccagcatgatattgaatatttgattctgaaaactaaagactctttaacagattaggggattgcctactttttaaaaagtttttatttataatatgagtatatgtaaaattttaaatagatcttttacatggacatgattatttgtttctatttgatataccactacaatatattgacagttttcctgctactgaatcaatacttataatggcaaataatttaactgtttgttatattctatgtatgctgtatgtaatttttacatctacacatttaagtaactttagctgataccgttatatttgtcagattttaagattagcaccataattactcatagaagcaactatgtgaccccatctttttcatgacatatttatgccacataagaactgagtgttcaacagttagagtcatctttaaaccttcagtagaaggacagtttgaaaatcattgcaatattttcttcagtctttttttaggttttgtgaattacgcagtttaatatttttgtttaatcttagaaaattgttgtacatagtgtttcctaataatttatttgtgctctgtactgattattgtattttctcacatttatgttaaattttattagtaagattattttctctatttatcagttttgtaaaatgttaaaaattcataaaagccaactgactattggctttaaactaccaataatttagttgatctctatattattatattactctgttaaaatttaattgtattttttgtaaggttttttttcctcttttatatttgctagtattttataaagtatttgttatttcaaaagaaacaactattggccagttaactttcatgccgctattttcatttcctggtatgcttattgctactttgtttttggtggctaccttattaaaacttttagaaatttcagttt

SEQ ID NO: 369209 - DNA, 5165 bp, Homo sapiens
accaattcccttcctgggagttgcggcttccctcgctcggccccactcccgtttaccctttccccagctcccgccttagccaggggcttccccgcctgccgctagggctcgggccgaagcgccgctcagcgccagcctgccgctccccgggctccactttcactttcggtcctgggggagctaggccggcggcagtggtggtggcggcggcgcaagggtgagggcggccccagaaccccaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccgtcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagataaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggctcaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacaccctgtgtctacacctgtggaaaatcctgctcagatccgggagatgtttgatgatgtttcttatgataagggagcttgtattctgaatatgctaagggagtatcttagtgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaagggttttcccctaataaccatcacagtgagggggaggaatgtacacatgaagcaagagcactacatgaagggctctgacggcgccccggacactgggtacctgtggcatgttccattgacattcatcaccagcaaatccgacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcaagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcgaatgctgcggagtcaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggctactagatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacgtatgtaaaaattcctcccttgccaggttcctgttatctctaatcaccaacattttgttgagtgtattttcaaactagagatggctgttttggctccaactggagatacttttttcccttcaactcattttttgactatccctgtgaaaagaatagctgttagtttttcatgaatgggctatcgctaccatgtgttttgttcatcacaggtgttgccctgcaacgtaaacccaagtgttgggttccctgccacagaagaataaagtaccttattcttctcattttatagtttatgcttaagcacccgtgtccaaaacctctgaatagtcgactactgaacaatgaacacctggatctgagactaagccggacgatgactgggttaaagctctcccggctcacccctccagacccgctgcccatccctcttccttgctccatgcccaggggctgacttgtaaaggccaagtcatcaagctttcttgccctttggatgttggtcagtggggagccggagagctggagctggggtcggaggaggtagtaggtggaggtgttcttccctgattcccttgcgggatgcctcgggctggcctcccctgagggtcttagctccgagaggggaccctcttttccacacagccttctccacctctggattttggtaactgctccctcctcatcccttcaggattagtggcctcagtgggagtctggcttttactagtcctggcggacttgtggtttctacataatgtgctcgcacttttgcaaaaaatctttttatagaaccctcctcagataattctgagtgtcatctatttccctgactggtacagtatctcttctgaaaaagcagagtgcattcaagtctgtaggaaaacccttttcttagggaggtgattttttttctctctctgcttcttatttggcctactttacaatttctaactaactagttattggcatttactgacagtaaattattgcagtcaccaataaatgatagtacattgtgaaacaaaatatttgctcatattagcaaataggacattctttggctttgaagtctttcttttgtgaagacttcacacacggttgcttcagcacacagttgctgctcaggttttatgtatagatgataataatagaaagcacagtttactaacatggtaaaccaacggagttcaagtcaagtcagttaataccctaagaattagattttatttcttattctgaaaacttgctacacagggacttatctaacccatagtgtgctctgttgctgacttgattcaagttgcagcgtgttttgcgctgactctaaggtgcggaaatcctcacacctggcaaaggagaattcaaactgaactttttgaatggtttaataaaaatagaaatcactggtaatttccaccccaaactaaactatttcccttcttttaaaaaaatacacaaccaagattttaatgtaaaatattttgctttaattgtattttatgccttgattaatgaaacatggaaatattgattttcagttttggtcacctgaggaacctatctttgtttgcttttggaaaagcccattttctaaacagatacaatattgccacaacaatgtgcagaaacctttttgataataaaaaattgttctttgcctctaagtggatatttgcaattattttctctctcctaactagactgtaaaaagggctgctttagatcctgtagcttactccagttattagttattaacaaacacccaagtctcgaagatatttctaattaaaaaagaaggcatattcagagttctttttaaataaatgttgtttacttttataggcatctttaaacttctggattttggtatgccatttaaaaatacttccagatacacatggaaattagtaatactgcagccgtatccttgcaaacacatctgtcagtgtcaaaggtttcaaggtttttcttaaaaaaagaaaacaaaaaagcaaacacctatactgcccaaatgggaggattagatacatggttagaaatccctcaggaaaagtgttttttcttttcttgttgctgccttaaaaataga

SEQ ID NO: 369210 - DNA, 2650 bp, Homo sapiens
ttttgctttttagatatcatgtttttaaaaaacgaagtttgcatctgtgagaacagaacagaataacacattaaatagacacaattaaaccttaattataaaatggtaaacagtgaagtcttttaaagtctggcaactgagaataaacaaaagaactgcagacaaaaaacagaacttgacatcatgaggcatgagctcatttcatacagcttatgtgtacataatcctattcagacagctgggactgccttctatatagaattttgacaaatgctggaattttggcttcagttttaactaaagttacatctgattaatgtgataaaattaattttttaaaacccactttttcctcacaaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacgtatgtaaaaattcctcccttgccaggttcctgttatctctaatcaccaacattttgttgagtgtattttcaaactagagatggctgttttggctccaactggagatacttttttcccttcaactcattttttgactatccctgtgaaaagaatagctgttagtttttcatgaatgggctatcgctaccatgtgttttgttcatcacaggtgttgccctgcaacgtaaacccaagtgttgggttccctgccacagaagaataaagtaccttattcttctcattttatagtttatgcttaagcacccgtgtccaaaaccctgtaccccatgtttatcattcataaactgtttcatcagtctcctcgaaagactctgaatagtcgactactgaacaatgaacacctggatctgagactaagccggacgatgactgggttaaagctctcccggctcacccctccagacccgctgcccatccctcttccttgctccatgcccaggggctgacttgtaaaggccaagtcatcaagctttcttgccctttggatgttggtcagtggggagccggagagctggagctggggtcggaggaggtagtaggtggaggtgttcttccctgattcccttgcgggatgcctcgggctggcctcccctgagggtcttagctccgagaggggaccctcttttccacacagccttctccacctctggattttggtaactgctccctcctcatcccttcaggattagtggcctcagtgggagtctggcttttactagtcctggcggacttgtggtttctacataatgtgctcgcacttttgcaaaaaatctttttatagaaccctcctcagataattctgagtgtcatctatttccctgactggtacagtatctcttctgaaaaagcagagtgcattcaagtctgtaggaaaacccttttcttagggaggtgattttttttctctctctgcttcttatttggcctactttacaatttctaactaactagttattggcatttactgacagtaaattattgcagtcaccaataaatgatagtacattgtgaaacaaaatatttgctcatattagcaaataggacattctttggctttgaagtctttcttttgtgaagacttcacacacggttgcttcagcacacagttgctgctcaggttttatgtatagatgataataatagaaagcacagtttactaacatggtaaaccaacggagttcaagtcaagtcagttaataccctaagaattagattttatttcttattctgaaaacttgctacacagggacttatctaacccatagtgtgctctgttgctgacttgattcaagttgcagcgtgttttgcgctgactctaaggtgcggaaatcctcacacctggcaaaggagaattcaaactgaactttttgaatggtttaataaaaatagaaatcactggtaatttccaccccaaactaaactatttcccttcttttaaaaaaatacacaaccaagattttaatgtaaaatattttgctttaattgtattttatgccttgattaatgaaacatggaaatattgattttcagttttggtcacctgaggaacctatctttgtttgcttttggaaaagcccattttctaaacagatacaatattgccacaacaatgtgcagaaacctttttgataataaaaaattgttctttgcctctaagtggatatttgcaattattttctctctcctaactagactgtaaaaagggctgctttagatcctgtagcttactccagttattagttattaacaaacacccaagtctcgaagatatttctaattaaaaaagaaggcatattcagagttctttttaaataaatgttgtttacttttataggcatctttaaacttctggattttggtatgccatttaaaaatacttccagatacacatggaaattagtaatactgcagccgtatccttgcaaacacatctgtcagtgtcaaaggtttcaaggtttttcttaaaaaaagaaaacaaaaaagcaaacacctatactgcccaaatgggaggattagatacatggttagaaatccctcaggaaaagtgttttttcttttcttgttgctgccttaaaaataga

SEQ ID NO: 369211 - DNA, 2646 bp, Homo sapiens
catgaacacatttgcttgttcacatctgtctttgtctaactcttatagcatttcctgcttctgtcattttctgttggatacttaaccttttattaggctgttggtgtgtattattctttacagctagatcttaacccattggatagacatcatattttgtatttttcacaccgatcagtttttagctgaaagctattatatataggaggcccttaaaatatatgttaaatgaataagtatttcacaacccgtttttgaatatttccctctctaggtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacgtatgtaaaaattcctcccttgccaggttcctgttatctctaatcaccaacattttgttgagtgtattttcaaactagagatggctgttttggctccaactggagatacttttttcccttcaactcattttttgactatccctgtgaaaagaatagctgttagtttttcatgaatgggctatcgctaccatgtgttttgttcatcacaggtgttgccctgcaacgtaaacccaagtgttgggttccctgccacagaagaataaagtaccttattcttctcattttatagtttatgcttaagcacccgtgtccaaaaccctgtaccccatgtttatcattcataaactgtttcatcagtctcctcgaaagactctgaatagtcgactactgaacaatgaacacctggatctgagactaagccggacgatgactgggttaaagctctcccggctcacccctccagacccgctgcccatccctcttccttgctccatgcccaggggctgacttgtaaaggccaagtcatcaagctttcttgccctttggatgttggtcagtggggagccggagagctggagctggggtcggaggaggtagtaggtggaggtgttcttccctgattcccttgcgggatgcctcgggctggcctcccctgagggtcttagctccgagaggggaccctcttttccacacagccttctccacctctggattttggtaactgctccctcctcatcccttcaggattagtggcctcagtgggagtctggcttttactagtcctggcggacttgtggtttctacataatgtgctcgcacttttgcaaaaaatctttttatagaaccctcctcagataattctgagtgtcatctatttccctgactggtacagtatctcttctgaaaaagcagagtgcattcaagtctgtaggaaaacccttttcttagggaggtgattttttttctctctctgcttcttatttggcctactttacaatttctaactaactagttattggcatttactgacagtaaattattgcagtcaccaataaatgatagtacattgtgaaacaaaatatttgctcatattagcaaataggacattctttggctttgaagtctttcttttgtgaagacttcacacacggttgcttcagcacacagttgctgctcaggttttatgtatagatgataataatagaaagcacagtttactaacatggtaaaccaacggagttcaagtcaagtcagttaataccctaagaattagattttatttcttattctgaaaacttgctacacagggacttatctaacccatagtgtgctctgttgctgacttgattcaagttgcagcgtgttttgcgctgactctaaggtgcggaaatcctcacacctggcaaaggagaattcaaactgaactttttgaatggtttaataaaaatagaaatcactggtaatttccaccccaaactaaactatttcccttcttttaaaaaaatacacaaccaagattttaatgtaaaatattttgctttaattgtattttatgccttgattaatgaaacatggaaatattgattttcagttttggtcacctgaggaacctatctttgtttgcttttggaaaagcccattttctaaacagatacaatattgccacaacaatgtgcagaaacctttttgataataaaaaattgttctttgcctctaagtggatatttgcaattattttctctctcctaactagactgtaaaaagggctgctttagatcctgtagcttactccagttattagttattaacaaacacccaagtctcgaagatatttctaattaaaaaagaaggcatattcagagttctttttaaataaatgttgtttacttttataggcatctttaaacttctggattttggtatgccatttaaaaatacttccagatacacatggaaattagtaatactgcagccgtatccttgcaaacacatctgtcagtgtcaaaggtttcaaggtttttcttaaaaaaagaaaacaaaaaagcaaacacctatactgcccaaatgggaggattagatacatggttagaaatccctcaggaaaagtgttttttcttttcttgttgctgccttaaaaataga

SEQ ID NO: 369212 - DNA, 1511 bp, Homo sapiens
gttgactctagcactggacgccgaggataacatctataactgggggaaccttttagagacacagccttctccacctctggattttggtaactgctccctcctcatcccttcaggattagtggcctcagtgggagtctggcttttactagtcctggcggacttgtggtttctacataatgtgctcgcacttttgcaaaaaatctttttatagaaccctcctcagataattctgagtgtcatctatttccctgactggtacagtatctcttctgaaaaagcagagtgcattcaagtctgtaggaaaacccttttcttagggaggtgattttttttctctctctgcttcttatttggcctactttacaatttctaactaactagttattggcatttactgacagtaaattattgcagtcaccaataaatgatagtacattgtgaaacaaaatatttgctcatattagcaaataggacattctttggctttgaagtctttcttttgtgaagacttcacacacggttgcttcagcacacagttgctgctcaggttttatgtatagatgataataatagaaagcacagtttactaacatggtaaaccaacggagttcaagtcaagtcagttaataccctaagaattagattttatttcttattctgaaaacttgctacacagggacttatctaacccatagtgtgctctgttgctgacttgattcaagttgcagcgtgttttgcgctgactctaaggtgcggaaatcctcacacctggcaaaggagaattcaaactgaactttttgaatggtttaataaaaatagaaatcactggtaatttccaccccaaactaaactatttcccttcttttaaaaaaatacacaaccaagattttaatgtaaaatattttgctttaattgtattttatgccttgattaatgaaacatggaaatattgattttcagttttggtcacctgaggaacctatctttgtttgcttttggaaaagcccattttctaaacagatacaatattgccacaacaatgtgcagaaacctttttgataataaaaaattgttctttgcctctaagtggatatttgcaattattttctctctcctaactagactgtaaaaagggctgctttagatcctgtagcttactccagttattagttattaacaaacacccaagtctcgaagatatttctaattaaaaaagaaggcatattcagagttctttttaaataaatgttgtttacttttataggcatctttaaacttctggattttggtatgccatttaaaaatacttccagatacacatggaaattagtaatactgcagccgtatccttgcaaacacatctgtcagtgtcaaaggtttcaaggtttttcttaaaaaaagaaaacaaaaaagcaaacacctatactgcccaaatgggaggattagatacatggttagaaatccctcaggaaaagtgttttttcttttcttgttgctgccttaaaaataga

SEQ ID NO: 369213 - DNA, 516 bp, Homo sapiens
tacaagtaattttattgcagtgattcataactgtttcatcacctattcattgctaacatttcttttcttaatccttctaggctactagatgaaagctttaagggagataaaataaaaactcaggagtttccacaaattcttacactcattggcaggaacccagtaggatacccactggcctggcaatttctgaggaaaaactggaacaaacttgtacaaaagtaagtggtgccaaaaattgtgctgtgactggataagttcataaccttactgtgttttagccttgctgtttgtaaaagaacagtaacagtctaaaggtactttttgattgaagataggcagtagaaatacctaaaatatttgtagaaaacataaaactggacttcagtgctaactagtgaatctggacagggatgttttccattccatctggcataaccccttcctgagcccatggacatatctgaagccttcctcctcacagttcagcccaggccttccatgaacacatttgct

SEQ ID NO: 369214 - DNA, 315 bp, Homo sapiens
aaaaaaaaaaaaaaaaaaaaggcctgagatgcaagtctgactttgccacatttatagcaaagtgatgctgagtcactaagcctctttttctccattgtgaaaggttcttccagtctagagctccatgattatgcacgggcagctggttcaaacacctatccattctgaagattagtgtttgggagaatgtatagcttagagactggtaatgtattttattacttccttcccaagatcttgctgctattcccgactttcagtctggtgctatggaaaactggggactgacaacatatagagaatctgctctgttgt

SEQ ID NO: 369215 - DNA, 346 bp, Homo sapiens
taagagtgatgtgtttatttttggtttttagatttgccctacagatggtgtaaaagggatggatggcttttgctctagaagtcaacattcatcttcatcctcagtaagtttctatatctgtacatgttcccccaagcacattcttttactgcatattctttgaaaggcagctctgtgccaaactttctgaggtccttgattatatcaccctcattccagataagactgcatttaaactattccatactcataatctttttcaatttttcttaaagtgtatctatactggagggttgcagagctttccttggtaatgcttctcactgatactaatttctctagcttc

SEQ ID NO: 369216 - DNA, 5413 bp, Homo sapiens
accaattcccttcctgggagttgcggcttccctcgctcggccccactcccgtttaccctttccccagctcccgccttagccaggggcttccccgcctgccgctagggctcgggccgaagcgccgctcagcgccagcctgccgctccccgggctccactttcactttcggtcctgggggagctaggccggcggcagtggtggtggcggcggcgcaagggtgagggcggccccagaaccccaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccgtcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagataaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggctcaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacaccctgtgtctacacctgtggaaaatcctgctcagatccgggagatgtttgatgatgtttcttatgataagggagcttgtattctgaatatgctaagggagtatcttagtgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaagggttttcccctaataaccatcacagtgagggggaggaatgtacacatgaagcaagagcactacatgaagggctctgacggcgccccggacactgggtacctgtggcatgttccattgacattcatcaccagcaaatccgacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcaagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcgaatgctgcggagtcaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggctactagatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacgtatgtaaaaattcctcccttgccaggttcctgttatctctaatcaccaacattttgttgagtgtattttcaaactagagatggctgttttggctccaactggagatacttttttcccttcaactcattttttgactatccctgtgaaaagaatagctgttagtttttcatgaatgggctatcgctaccatgtgttttgttcatcacaggtgttgccctgcaacgtaaacccaagtgttgggttccctgccacagaagaataaagtaccttattcttctcattttatagtttatgcttaagcacccgtgtccaaaaccctgtaccccatgtttatcattcataaactgtttcatcagtctcctcgaaagactctgaatagtcgactactgaacaatgaacacctggatctgagactaagccggacgatgactgggttaaagctctcccggctcacccctccagacccgctgcccatccctcttccttgctccatgcccaggggctgacttgtaaaggccaagtcatcaagctttcttgccctttggatgttggtcagtggggagccggagagctggagctggggtcggaggaggtagtaggtggaggtgttcttccctgattcccttgcgggatgcctcgggctggcctcccctgagggtcttagctccgagaggggaccctcttttccacacagccttctccacctctggattttggtaactgctccctcctcatcccttcaggattagtggcctcagtgggagtctggcttttactagtcctggcggacttgtggtttctacataatgtgctcgcacttttgcaaaaaatctttttatagaaccctcctcagataattctgagtgtcatctatttccctgactggtacagtatctcttctgaaaaagcagagtgcattcaagtctgtaggaaaacccttttcttagggaggtgattttttttctctctctgcttcttatttggcctactttacaatttctaactaactagttattggcatttactgacagtaaattattgcagtcaccaataaatgatagtacattgtgaaacaaaatatttgctcatattagcaaataggacattctttggctttgaagtctttcttttgtgaagacttcacacacggttgcttcagcacacagttgctgctcaggttttatgtatagatgataataatagaaagcacagtttactaacatggtaaaccaacggagttcaagtcaagtcagttaataccctaagaattagattttatttcttattctgaaaacttgctacacagggacttatctaacccatagtgtgctctgttgctgacttgattcaagttgcagcgtgttttgcgctgactctaaggtgcggaaatcctcacacctggcaaaggagaattcaaactgaactttttgaatataaggcaaaaacttcaagataagggaatatgattgatgattggtacgaaaaatgtcaaaatgtgttcccctaatacacgacaaaatagagtgacttctggacataaatctgccatttattaaaccattcactacaacaaataaataggtataaaagtggaattggaatttttatacttatttgttgtagtgaatggtttaataaaaatagaaatcactggtaatttccaccccaaactaaactatttcccttcttttaaaaaaatacacaaccaagattttaatgtaaaatattttgctttaattgtattttatgccttgattaatgaaacatggaaatattgattttcagttttggtcacctgaggaacctatctttgtttgcttttggaaaagcccattttctaaacagatacaatattgccacaacaatgtgcagaaacctttttgataataaaaaattgttctttgcctctaagtggatatttgcaattattttctctctcctaactagactgtaaaaagggctgctttagatcctgtagcttactccagttattagttattaacaaacacccaagtctcgaagatatttctaattaaaaaagaaggcatattcagagttctttttaaataaatgttgtttacttttataggcatctttaaacttctggattttggtatgccatttaaaaatacttccagatacacatggaaattagtaatactgcagccgtatccttgcaaacacatctgtcagtgtcaaaggtttcaaggtttttcttaaaaaaagaaaacaaaaaagcaaacacctatactgcccaaatgggaggattagatacatggttagaaatccctcaggaaaagtgttttttcttttcttgttgctgccttaaaaataga

SEQ ID NO: 369217 - DNA, 603 bp, Homo sapiens
accaattcccttcctgggagttgcggcttccctcgctcggccccactcccgtttaccctttccccagctcccgccttagccaggggcttccccgcctgccgctagggctcgggccgaagcgccgctcagcgccagcctgccgctccccgggctccactttcactttcggtcctgggggagctaggccggcggcagtggtggtggcggcggcgcaagggtgagggcggccccagaaccccaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgcacgctgccgtcgcctacgcacgtgcctaggcgacggcgcgcggtggccgcctcagaggatcacgcaggccgagcagcagccctcatcgccgttgggctgcgccgcgtagtcatctaagcacgccg

SEQ ID NO: 369218 - DNA, 5218 bp, Homo sapiens
accaattcccttcctgggagttgcggcttccctcgctcggccccactcccgtttaccctttccccagctcccgccttagccaggggcttccccgcctgccgctagggctcgggccgaagcgccgctcagcgccagcctgccgctccccgggctccactttcactttcggtcctgggggagctaggccggcggcagtggtggtggcggcggcgcaagggtgagggcggccccagaaccccaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccgtcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagataaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggctcaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacaccctgtgtctacacctgtggaaaatcctgctcagatccgggagatgtttgatgatgtttcttatgataagggagcttgtattctgaatatgctaagggagtatcttagtgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaagggttttcccctaataaccatcacagtgagggggaggaatgtacacatgaagcaagagcactacatgaagggctctgacggcgccccggacactgggtacctgtggcatgttccattgacattcatcaccagcaaatccgacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcaagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcgaatgctgcggagtcaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggctactagatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacgtatgtaaaaattcctcccttgccaggttcctgttatctctaatcaccaacattttgttgagtgtattttcaaactagagatggctgttttggctccaactggagatacttttttcccttcaactcattttttgactatccctgtgaaaagaatagctgttagtttttcatgaatgggctatcgctaccatgtgttttgttcatcacaggtgttgccctgcaacgtaaacccaagtgttgggttccctgccacagaagaataaagtaccttattcttctcattttatagtttatgcttaagcacccgtgtccaaaaccctgtaccccatgtttatcattcataaactgtttcatcagtctcctcgaaagactctgaatagtcgactactgaacaatgaacacctggatctgagactaagccggacgatgactgggttaaagctctcccggctcacccctccagacccgctgcccatccctcttccttgctccatgcccaggggctgacttgtaaaggccaagtcatcaagctttcttgccctttggatgttggtcagtggggagccggagagctggagctggggtcggaggaggtagtaggtggaggtgttcttccctgattcccttgcgggatgcctcgggctggcctcccctgagggtcttagctccgagaggggaccctcttttccacacagccttctccacctctggattttggtaactgctccctcctcatcccttcaggattagtggcctcagtgggagtctggcttttactagtcctggcggacttgtggtttctacataatgtgctcgcacttttgcaaaaaatctttttatagaaccctcctcagataattctgagtgtcatctatttccctgactggtacagtatctcttctgaaaaagcagagtgcattcaagtctgtaggaaaacccttttcttagggaggtgattttttttctctctctgcttcttatttggcctactttacaatttctaactaactagttattggcatttactgacagtaaattattgcagtcaccaataaatgatagtacattgtgaaacaaaatatttgctcatattagcaaataggacattctttggctttgaagtctttcttttgtgaagacttcacacacggttgcttcagcacacagttgctgctcaggttttatgtatagatgataataatagaaagcacagtttactaacatggtaaaccaacggagttcaagtcaagtcagttaataccctaagaattagattttatttcttattctgaaaacttgctacacagggacttatctaacccatagtgtgctctgttgctgacttgattcaagttgcagcgtgttttgcgctgactctaaggtgcggaaatcctcacacctggcaaaggagaattcaaactgaactttttgaatggtttaataaaaatagaaatcactggtaatttccaccccaaactaaactatttcccttcttttaaaaaaatacacaaccaagattttaatgtaaaatattttgctttaattgtattttatgccttgattaatgaaacatggaaatattgattttcagttttggtcacctgaggaacctatctttgtttgcttttggaaaagcccattttctaaacagatacaatattgccacaacaatgtgcagaaacctttttgataataaaaaattgttctttgcctctaagtggatatttgcaattattttctctctcctaactagactgtaaaaagggctgctttagatcctgtagcttactccagttattagttattaacaaacacccaagtctcgaagatatttctaattaaaaaagaaggcatattcagagttctttttaaataaatgttgtttacttttataggcatctttaaacttctggattttggtatgccatttaaaaatacttccagatacacatggaaattagtaatactgcagccgtatccttgcaaacacatctgtcagtgtcaaaggtttcaaggtttttcttaaaaaaagaaaacaaaaaagcaaacacctatactgcccaaatgggaggattagatacatggttagaaatccctcaggaaaagtgttttttcttttcttgttgctgccttaaaaataga

SEQ ID NO: 369219 - DNA, 5488 bp, Homo sapiens
accaattcccttcctgggagttgcggcttccctcgctcggccccactcccgtttaccctttccccagctcccgccttagccaggggcttccccgcctgccgctagggctcgggccgaagcgccgctcagcgccagcctgccgctccccgggctccactttcactttcggtcctgggggagctaggccggcggcagtggtggtggcggcggcgcaagggtgagggcggccccagaaccccaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccgtcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagataaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggctcaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacaccctgtgtctacacctgtggaaaatcctgctcagatccgggagatgtttgatgatgtttcttatgataagggagcttgtattctgaatatgctaagggagtatcttagtgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaagggttttcccctaataaccatcacagtgagggggaggaatgtacacatgaagcaagagcactacatgaagggctctgacggcgccccggacactgggtacctgtggcatgttccattgacattcatcaccagcaaatccgacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcaagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcgaatgctgcggagtcaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggctactagatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacatgatcctgaagctgacgcaacaggatgaaaatccatcagaatctcagactacagcactaaatatgctttgatgctacatcaaacggaatggaagcatagctgacttcgctaaagttacttcatctccatctagcaaatgaggcactgttctcaaccaaaggagatggggatctggtttagggcaatccctttataatttgatgtgctgtggtctccttggtaatgtataatttggtattgcacaggtgattagtcaaggaagtctggaaaagctttggtcccacagccttgcctcacagcatgtaaataattaaaacaatattgatgctgaggttcttctactgctagtatgaaagtgacaaatttttactggtgtgaattgggaagaaaacaatgctattccatgacgtttgtaaaatgtttgtaaaagctcaaacatgacgattccataaaataaacttgaggttaaataatgggtagtaaattatagaatgtataagaaaaaatataaaggagaaaatcaattatcaggaaagctaaagaacttttcaaatctagtaatttgaatatagacacaatgcactttattgcactttcaattcttataaagcaacaataatattaaggtccttgactatgtgtacaatgttttcacatatatagtttcatttaatcatttcaaagttaatctctgccatctcgctaaatcatcagtctcggctcttctgaaatagaaggtgcctgatcttcctaataattctgcctattttcatttgctttaaacaggcgccctattttctttctagttgtggctgcgcaaaaacatttatctcccaaataagatgtgctgcttaccgaggtatcacggggtggggctccagcttgggtcgttgaagctggggtttgggaaaccacttcagagatggcagcagcaagtttagcatcttcaaatttcttttattgaaaaaaattttattagtaacatgttgtatataaaattatgagcacaatgccatcacttaactataactcttaaagatagcttaatgactgtttattctcttgaccaaatagactcataataacatataattttaaaagaaatttaaattctttcttctctattgtattattttatacaatttgctatttctatttccttctcatattgattattctaaatactatgcaataatataacttagagttccacggtttgtttacacatttcctgttgtacatttaggttattcaaagttttcagctcttttaaaattgctctgaataagttctagtgagtgagttatggtgctggctatattttgctaaactgccctctcaaatgttgctaggaattcatactgcgaaaagcaatgaataagcatgcctgttttcccatggccttgcttgccagaatttgacttttattatgataatcagtgtaaaatgatatactactattgcttgtatattgtggtatacggtgtcaggtttcagggttttttttcaacgttaaatattctagaaactttctgaaataatttctgtttaaaaatattgaatatttgcttcatttcaaatactcccttttgacaaaaaaacttaggtataactgttgatgaaaaaccagaaaaaagtccagaactctttggtgactccaactatggatagcttattttgaaaaaggagaattgcaaattttaccaaaagatggagaaaagcacattaaaaagataccaacattcagaaattcatttcagcatgttattattggaaattatttaaactaatttagataactataagatacttattgtccatttataccctgtaaagccgttttagaatgtaatattttaggtaatccaaaatgtactaaattaaattcatttttagttatgagaaatctttgcttatatgacaaatgaaaagaataacaagttgtcaaatgaaaagaatgacattgaaacatttgtattgtctcttcttaaactatcttattgacttattatttaagccttttaatactaagtatgaaacaacctatggtctggaaatttgtatcgcaaagctatatgtgcatatgttatttaattcatctaacgctacacaaaagcataaaataatgatttttcactctctttaaaaatactaaatcatttatgtccatttctcaattttttcattgatctatgctttgagtttgctttctcaacattattgtattttccacttattattactgtataacatatgctagtgtttagttggattaatcttacctaaaagtactgaaaaatgctttttagtactttttcatattttatacatttattttccgaatgtatcattgaataattttattgagttataaaagtatcttattgctatttaataaaaaattaacacat

SEQ ID NO: 369220 - DNA, 656 bp, Homo sapiens
ccaagtgtttcctcagcttttctgcaccttcctctccattgacctagagtgtctatggaacactcagagtgtcccctgtgtaaaccacctaccacaagattatcaacttcaggcaatggaccacgcaccaggattccacctctttctagcacctatcagtgttgcgcacatcataggccctcaacaaacaggcagccacgctgggggatcccacatggtaaagaactgcaggtggcctctaggagatgagggcggcctccagtcaacagccagcaagaaactgaagtgctctgtcctacaaccttgtgtaactgaattctgccaacaacctgagtgagactgaaagtggatccctctccagtcatgcctcagtgtgagagaaacctgtgacttgcttctaacccataggatatggcaaggaactagtcatatctgagagcagcctccagaaaacagtcagcaaaacactgaggttctcaatccgatagtcaatgaggaacggaatgctggaacaatgatgtgagcttggaagcagatccttcccttctgctgggcctcaggtgagactgcagctccagtcatcatcttgattgcagcccacagaaactaccaacccacagaaactgtgagttaataaatgtgttgttttaaaatga

SEQ ID NO: 369221 - DNA, 1199 bp, Homo sapiens
gaattcgaggatccgggtaccatgggaggaaaacttcttcctggcctgggctccgtgccgctctgtttgccaaccgtccagtcccgcctaccagtgccgggcgctccccacccctcccccggctcccccggtgtccgccatggccaaagcctacgaccacctcttcaagttgctgctgatcggggactcgggggtgggcaagacttgtctgatcattcgctttgcagaggacaacttcaacaacacttacatctccaccatcggaattgatttcaagatccgcactgtggatatagaggggaagaagatcaaactacaagtctgggacacggctggccaagagcggttcaagacaataactactgcctactaccgtggagccatgggcattatcctagtatacgacatcacggatgagaaatctttcgagaatattcagaactggatgaaaagcatcaaggagaatgcctcggctggggtggagcgcctcttgctggggaacaaatgtgacatggaggccaagaggaaggtgcagaaggagcaggccgataagttggctcgagagcatggaatccgatttttcgaaactagtgctaaatccagtatgaatgtggatgaggcttttagttccctggcccgggacatcttgctcaagtcaggaggccggagatcaggaaacggcaacaagcctcccagtactgacctgaaaacttgtgacaagaagaacaccaacaagtgctccctgggctgaggaccctttcttgcctccccaccccggaagctgaacctgagggagacaacggcagagggagtgagcaggggagaaatagcagaggggcttggagggtcacataggtagatggtaaagagaatgaggagaaaaaggagaaaagggaaaagcagaaaggaaaaaaaggaagagagaggaagggagaagggagaggaatgaattgaggaagtgaaagaaggcaaggaggtaggaagagagggaggaggaaaggaaggagagatgcctcaggcttcagaccttacctgggttttcagggcaaacataaatgtaaatacactgatttattctgttactagatcaggttttagggtcctgcaaaaggctagctcggcactacactagggaatttgctcctgttctgtcacttgtcatggtctttcttggtattaaaggccaccatttgcacaaa

SEQ ID NO: 369222 - DNA, 1379 bp, Homo sapiens
gaattcgaggatccgggtaccatgggaggaaaacttcttcctggcctgggctccgtgccgctctgtttgccaaccgtccagtcccgcctaccagtgccgggcgctccccacccctcccccggctcccccggtgtccgccatggccaaagcctacgaccacctcttcaagttgctgctgatcggggactcgggggtgggcaagacttgtctgatcattcgctttgcagaggacaacttcaacaacacttacatctccaccatcggaattgatttcaagatccgcactgtggatatagaggggaagaagatcaaactacaagtctgggacacggctggccaagagcggttcaagacaataactactgcctactaccgtggagccatgggcattatcctagtatacgacatcacggatgagaaatctttcgagaatattcagaactggatgaaaagcatcaaggagaatgcctcggctggggtggagcgcctcttgctggggaacaaatgtgacatggaggccaagaggaaggtgcagaaggagcaggccgataagttggctcgagagcatggaatccgatttttcgaaactagtgctaaatccagtatgaatgtggatgaggcttttagttccctggcccgggacatcttgctcaagtcaggaggccggagatcaggaaacggcaacaagcctcccagtactgacctgaaaacttgtgacaagaagaacaccaacaagtgctccctgggctgaggaccctttcttgcctccccaccccggaagctgaacctgagggagacaacggcagagggagtgagcaggggagaaatagcagaggggcttggagggtcacataggtagatggtaaagagaatgaggagaaaaaggagaaaagggaaaagcagaaaggaaaaaaaggaagagagaggaagggagaagggagaggaatgaattgaggaagtgaaagaaggcaaggaggtaggaagagagggaggaggaaaggaaggagagatgcctcaggcttcagaccttacctgggttttcagggcaaacataaatgtaaatacactgatttattctgttactagatcaggttttagggtcctgcaaaaggctagctcggcactacactagggaatttgctcctgttctgtcacttgtcatggtctttcttggtattaaaggccaccatttgcacaaaaaaaaaaacaaaaggggggggtctaaaaataccgggggccagtttaggtttccggttttgacaagggcctaggggggtaaaaaagagggggggttaaaggggggggaacggtgggtttgggagaccttcggggggatggcaaccaaaatagcggaaatggagggaagcgggagtcgataa

SEQ ID NO: 369223 - DNA, 1586 bp, Homo sapiens
gaattcgaggatccgggtaccatgggaggaaaacttcttcctggcctgggctccgtgccgctctgtttgccaaccgtccagtcccgcctaccagtgccgggcgctccccacccctcccccggctcccccggtgtccgccatggccaaagcctacgaccacctcttcaagttgctgctgatcggggactcgggggtgggcaagacttgtctgatcattcgctttgcagaggacaacttcaacaacacttacatctccaccatcggaattgatttcaagatccgcactgtggatatagaggggaagaagatcaaactacaagtctgggacacggctggccaagagcggttcaagacaataactactgcctactaccgtggagccatgggcattatcctagtatacgacatcacggatgagaaatctttcgagaatattcagaactggatgaaaagcatcaaggagaatgcctcggctggggtggagcgcctcttgctggggaacaaatgtgacatggaggccaagaggaaggtgcagaaggagcaggccgataagttggctcgagagcatggaatccgatttttcgaaactagtgctaaatccagtatgaatgtggatgaggcttttagttccctggcccgggacatcttgctcaagtcaggaggccggagatcaggaaacggcaacaagcctcccagtactgacctgaaaacttgtgacaagaagaacaccaacaagtgctccctgggctgaggaccctttcttgcctccccaccccggaagctgaacctgagggagacaacggcagagggagtgagcaggggagaaatagcagaggggcttggagggtcacataggtagatggtaaagagaatgaggagaaaaaggagaaaagggaaaagcagaaaggaaaaaaaggaagagagaggaagggagaagggagaggaatgaattgaggaagtgaaagaaggcaaggaggtaggaagagagggaggaggaaaggaaggagagatgcctcaggcttcagaccttacctgggttttcagggcaaacataaatgtaaatacactgatttattctgttactagatcaggttttagggtcctgcaaaaggctagctcggcactacactagggaatttgctcctgttctgtcacttgtcatggtctttcttggtattaaaggccaccatttgcacaaagccactaaaaaaagaaaagaatgaaacaaaaacaagaaaacaattgtgtgtgggcgcgcgccccgggacccccaggagaaaggccttttatagaaccagactcgcgtgtgggaggcgcggcgggcccacgggatgaggttcagggaaaaactgggcacgaagagcggaggatacctcgaagagaagaactgcggcgaacagcgaaatagaggtgcgcgggcgcattttccacgcccaaaagaaaaaaagcgcccggggggaacaccgggagcgtttgtagcaacacatgtccggaaggggaagatcgggagagcagcaaagggggacttctacaaacgggggagccacaggcagaggcggaaatagaaaatacgcccgacccggggt

SEQ ID NO: 369224 - DNA, 1209 bp, Homo sapiens
gaattcgaggatccgggtaccatgggaggaaaacttcttcctggcctgggctccgtgccgctctgtttgccaaccgtccagtcccgcctaccagtgccgggcgctccccacccctcccccggctcccccggtgtccgccatggccaaagcctacgaccacctcttcaagttgctgctgatcggggactcgggggtgggcaagacttgtctgatcattcgctttgcagaggacaacttcaacaacacttacatctccaccatcggaattgatttcaagatccgcactgtggatatagaggggaagaagatcaaactacaagtctgggacacggctggccaagagcggttcaagacaataactactgcctactaccgtggagccatgggcattatcctagtatacgacatcacggatgagaaatctttcgagaatattcagaactggatgaaaagcatcaaggagaatgcctcggctggggtggagcgcctcttgctggggaacaaatgtgacatggaggccaagaggaaggtgcagaaggagcaggccgataagttggctcgagagcatggaatccgatttttcgaaactagtgctaaatccagtatgaatgtggatgaggcttttagttccctggcccgggacatcttgctcaagtcaggaggccggagatcaggaaacggcaacaagcctcccagtactgacctgaaaacttgtgacaagaagaacaccaacaagtgctccctgggctgaggaccctttcttgcctccccaccccggaagctgaacctgagggagacaacggcagagggagtgagcaggggagaaatagcagaggggcttggagggtcacataggtagatggtaaagagaatgaggagaaaaaggagaaaagggaaaagcagaaaggaaaaaaaggaagagagaggaagggagaagggagaggaatgaattgaggaagtgaaagaaggcaaggaggtaggaagagagggaggaggaaaggaaggagagatgcctcaggcttcagaccttacctgggttttcagggcaaacataaatgtaaatacactgatttattctgttactagatcaggttttagggtcctgcaaaaggctagctcggcactacactagggaatttgctcctgttctgtcactataactgtgttcttgatgagctcgttgctgttcttgtgctgctcgtatcgtgt

SEQ ID NO: 369225 - DNA, 1233 bp, Homo sapiens
gaattcgaggatccgggtaccatgggaggaaaacttcttcctggcctgggctccgtgccgctctgtttgccaaccgtccagtcccgcctaccagtgccgggcgctccccacccctcccccggctcccccggtgtccgccatggccaaagcctacgaccacctcttcaagttgctgctgatcggggactcgggggtgggcaagacttgtctgatcattcgctttgcagaggacaacttcaacaacacttacatctccaccatcggaattgatttcaagatccgcactgtggatatagaggggaagaagatcaaactacaagtctgggacacggctggccaagagcggttcaagacaataactactgcctactaccgtggagccatgggcattatcctagtatacgacatcacggatgagaaatctttcgagaatattcagaactggatgaaaagcatcaaggagaatgcctcggctggggtggagcgcctcttgctggggaacaaatgtgacatggaggccaagaggaaggtgcagaaggagcaggccgataagttggctcgagagcatggaatccgatttttcgaaactagtgctaaatccagtatgaatgtggatgaggcttttagttccctggcccgggacatcttgctcaagtcaggaggccggagatcaggaaacggcaacaagcctcccagtactgacctgaaaacttgtgacaagaagaacaccaacaagtgctccctgggctgaggaccctttcttgcctccccaccccggaagctgaacctgagggagacaacggcagagggagtgagcaggggagaaatagcagaggggcttggagggtcacataggtagatggtaaagagaatgaggagaaaaaggagaaaagggaaaagcagaaaggaaaaaaaggcacaaaacacgcgaccagacacgagcgcacaggcgcgacgcaacgggacgcagcgcaactgaccgttcgacggaagtgaaagaaggcaaggaggtaggaagagagggaggaggaaaggaaggagagatgcctcaggcttcagaccttacctgggttttcagggcaaacataaatgtaaatacactgatttattctgttactagatcaggttttagggtcctgcaaaaggctagctcggcactacactagggaatttgctcctgttctgtcacttgtcatggtctttcttggtattaaaggccaccatttgcacaaa

SEQ ID NO: 369226 - DNA, 801 bp, Homo sapiens
aattacaatagagtaacaaaaaggaaaatgggtatccggcagggttttcaggagagaaaattataaaaactgaactacaactactattaataaaattatggggctgtgtgtgatggctcacgcctgtaatcccagcactttgggaggccgataagttggctcgagagcatggaatccgatttttcgaaactagtgctaaatccagtatgaatgtggatgaggcttttagttccctggcccgggacatcttgctcaagtcaggaggccggagatcaggaaacggcaacaagcctcccagtactgacctgaaaacttgtgacaagaagaacaccaacaagtgctccctgggctgaggaccctttcttgcctccccaccccggaagctgaacctgagggagacaacggcagagggagtgagcaggggagaaatagcagaggggcttggagggtcacataggtagatggtaaagagaatgaggagaaaaaggagaaaagggaaaagcagaaaggaaaaaaaggaagagagaggaagggagaagggagaggaatgaattgaggaagtgaaagaaggcaaggaggtaggaagagagggaggaggaaaggaaggagagatgcctcaggcttcagaccttacctgggttttcagggcaaacataaatgtaaatacactgatttattctgttactagatcaggttttagggtcctgcaaaaggctagctcggcactacactagggaatttgctcctgttctgtcacttgtcatggtctttcttggtattaaaggccaccatttgcacaaa

SEQ ID NO: 369227 - DNA, 357 bp, Homo sapiens
aatagagacaataatacatgtcttacaaggaaagagtaaggattagataaaatgatacatacacagtgcttgacacatagcaaacattcaatgaataagcaaagacatcttgtttcttgggccactaccatctctggaaatcagctcaactgtctttaatcccgttcccctttactgtttccttattctgttgccccaccatgttacaaaagctaaattcttgtgagagaggaagaattattccgttggagaattcttccctctattccatcccatgaaaacttctccttctttagggacacggctggccaagagcggttcaagacaataactactgcctactaccgtggagccatg

SEQ ID NO: 369228 - DNA, 504 bp, Homo sapiens
ccctccaaactgactctgttccccactttaggcttttagttccctggcccgggacatcttgctcaagtcaggaggccggagatcagtaagttggttttgctggactaggtacaactctggggtgtgtgtgtgtgtatgtatgtgtgtgtgtgtgtgtgtgtgtgtgtgtgtgttggtgttgataaaaacggggagcaatgctaagatttctcatgagggtggatttactttaaacagtttataccctcctaccctaaccatccattcacaccatgacacctgtgcccttctccctctagggaaacggcaacaagcctcccagtactgacctgaaaacttgtgacaagaagaacaccaacaagtgctccctgggctgaggaccctttcttgcctccccaccccggaagctgaacctgagggagacaacggcagagggagtgagcaggggagaaatagcagaggggcttggagggtcacataggtagatggtaaagagaatgagga

SEQ ID NO: 369229 - DNA, 912 bp, Homo sapiens
ctctttcccggagcctgggcggagagggaggaaaacttcttcctggcctgggctccgtgccgctctgtttgccaaccgtccagtcccgcctaccagtgccgggcgctccccacccctcccccggctcccccggtgtccgccatggccaaagcctacgaccacctcttcaagttgctgctgatcggggactcgggggtgggcaagacttgtctgatcattcgctttgcagaggacaacttcaacaacacttacatctccaccatcggaattgatttcaagatccgcactgtggatatagaggggaagaagatcaaactacaagtctgggacacggctggccaagagcggttcaagacaataactactgcctactaccgtggagccatgggcattatcctagtatacgacatcacggatgagaaatctttcgagaatattcagaactggatgaaaagcatcaaggagaatgcctcggctggggtggagcgcctcttgctggggaacaaatgtgacatggaggccaagaggaaggtgcagaaggagcaggccgataagttggctcgagagcatggaatccgatttttcgaaactagtgctaaatccagtatgaatgtggatgaggcttttagttccctggcccgggacatcttgctcaagtcaggaggccggagatcaggaaacggcaacaagcctcccagtactgacctgaaaacttgtgacaagaagaacaccaacaagtgctccctgggctgaggaccctttcttgcctccccaccccggaagctgaacctgagggagacaacggcagagggaggacgagaacgcgcagtttcgcctccatcccttgacctccaacacagcttctccactggatcatcggtggcgatgaaggggcggctggggaaggatgtc

SEQ ID NO: 369230 - DNA, 1394 bp, Homo sapiens
gaattcgaggatccgggtaccatgggaggaaaacttcttcctggcctgggctccgtgccgctctgtttgccaaccgtccagtcccgcctaccagtgccgggcgctccccacccctcccccggctcccccggtgtccgccatggccaaagcctacgaccacctcttcaagttgctgctgatcggggactcgggggtgggcaagacttgtctgatcattcgctttgcagaggacaacttcaacaacacttacatctccaccatcggaattgatttcaagatccgcactgtggatatagaggggaagaagatcaaactacaagtctgggacacggctggccaagagcggttcaagacaataactactgcctactaccgtggagccatgggcattatcctagtatacgacatcacggatgagaaatctttcgagaatattcagaactggatgaaaagcatcaaggagaatgcctcggctggggtggagcgcctcttgctggggaacaaatgtgacatggaggccaagaggaaggtgcagaaggagcaggccgataagttggctcgagagcatggaatccgatttttcgaaactagtgctaaatccagtatgaatgtggatgaggcttttagttccctggcccgggacatcttgctcaagtcaggaggccggagatcaggaaacggcaacaagcctcccagtactgacctgaaaacttgtgacaagaagaacaccaacaagtgctccctgggctgaggaccctttcttgcctccccaccccggaagctgaacctgagggagacaacggcagagggagtgagcaggggagaaatagcagaggggcttggagggtcacataggtagatggtaaagagaatgaggagaaaaaggagaaaagggaaaagcagaaaggaaaaaaaggaagagagaggaagggagaagggagaggaatgaattgaggaagtgaaagaaggcaaggaggtaggaagagagggaggaggaaaggaaggagagatgcctcaggcttcagaccttacctgggttttcagggcaaacataaatgtaaatacactgatttattctgttactagatcaggttttagggtcctgcaaaaggctagctcggcactacactagggaatttgctcctgttctgtcacttgtcatggtctttcttggtattaaaggccaccatttgcacaaaaaaaaaaaaaaaaaaacaacaccccccgcgggcactacaatcataagggtcgcggcggaaaacgggtgtcctagacacgggaccacagggcccacacatgttcctccttaacccaaacattccttagcaccaacgcgagaaaacacgccgggatccccacacagggacgccaatatcaaatcagcgaaacccggg

SEQ ID NO: 369231 - DNA, 1295 bp, Homo sapiens
gaattcgaggatccgggtaccatgggaggaaaacttcttcctggcctgggctccgtgccgctctgtttgccaaccgtccagtcccgcctaccagtgccgggcgctccccacccctcccccggctcccccggtgtccgccatggccaaagcctacgaccacctcttcaagttgctgctgatcggggactcgggggtgggcaagacttgtctgatcattcgctttgcagaggacaacttcaacaacacttacatctccaccatcggtgagcccgctggccatgtcccagaccccgactctcctgtgacctccttctccggctcccggattactagtgaccccacttttcagtccccttagagaattgatttcaagatccgcactgtggatatagaggggaagaagatcaaactacaagtctgggacacggctggccaagagcggttcaagacaataactactgcctactaccgtggagccatgggcattatcctagtatacgacatcacggatgagaaatctttcgagaatattcagaactggatgaaaagcatcaaggagaatgcctcggctggggtggagcgcctcttgctggggaacaaatgtgacatggaggccaagaggaaggtgcagaaggagcaggccgataagttggctcgagagcatggaatccgatttttcgaaactagtgctaaatccagtatgaatgtggatgaggcttttagttccctggcccgggacatcttgctcaagtcaggaggccggagatcaggaaacggcaacaagcctcccagtactgacctgaaaacttgtgacaagaagaacaccaacaagtgctccctgggctgaggaccctttcttgcctccccaccccggaagctgaacctgagggagacaacggcagagggagtgagcaggggagaaatagcagaggggcttggagggtcacataggtagatggtaaagagaatgaggagaaaaaggagaaaagggaaaagcagaaaggaaaaaaaggaagagagaggaagggagaagggagaggaatgaattgaggaagtgaaagaaggcaaggaggtaggaagagagggaggaggaaaggaaggagagatgcctcaggcttcagaccttacctgggttttcagggcaaacataaatgtaaatacactgatttattctgttactagatcaggttttagggtcctgcaaaaggctagctcggcactacactagggaatttgctcctgttctgtcacttgtcatggtctttcttggtattaaaggccaccatttgcacaaa

SEQ ID NO: 369232 - DNA, 651 bp, Homo sapiens
gaattcgaggatccgggtaccatgggaggaaaacttcttcctggcctgggctccgtgccgctctgtttgccaaccgtccagtcccgcctaccacgcctcttgctggggaacaaatgtgacatggaggccaagaggaaggtgcagaaggagcaggccgataagttggctcgagagcatggaatccgatttttcgaaactagtgctaaatccagtatgaatgtggatgaggcttttagttccctggcccgggacatcttgctcaagtcaggaggccggagatcaggaaacggcaacaagcctcccagtactgacctgaaaacttgtgacaagaagaacaccaacaagtgctccctgggctgaggaccctttcttgcctccccaccccggaagctgaacctgagggagacaacggcagagggagtgagcaggggagaaatagcagaggggcttggagggtcacataggtagatggtaaagagaatgaggagaaaaaggagaaaagggaaaagcagaaaggaaaaaaaggaagagagaggaagggagaagggagaggaatgaattgaggaagtgaaagaaggcaaggaggttagaaccttagggttcttagggacgaaacataaactgttaaatacccctggtgtaattctggct

SEQ ID NO: 369233 - DNA, 844 bp, Homo sapiens
cgggggaggcagtttttgagttttggcctcaggcgtcagaatcttagaacgtctcaggctttttcttctctgttctctggaggcttccctgacctccccgcgttttccatggcgggcttgggtttgggaaaagggaagtaaaaaatcaggctgccccaagtgagatgctggcaactcttgggcctttagatttccaaaacctcattttgagcccttctgcagggtattaccaattaggcgccccctggggccgcgatgacatcttccctgaggatctgaggcaaatgtggtttactcccttgctcgaataaccctggcatatcctttgccaggtatcactggaaggatccccccgcaaaagagagggaaaagccgttaggtgtttgttgtgttctcctggataagggatggaattgggccaaattttcaagttaatttgtgtttaatccaccaacaactcaatccctcccccattaaaaaaaaaaaaaaaagcctaggggggtctctgcttctgcagacggtacctgccacgcatgccatagcttagtaactagtattaaccggttgggcttctgcttcctgaatactcggtccctttttcccttatgctgattaatttcaagatggaggagacagccacgttccttccctagacagtttcaccatacttattccacaggttagtctgggaatctgaggcctagcagtcttgttattgaggtcattttttttttcattttggggcaagaggaagcagttgtatcagattgtcatcttccatttgcaagaccccacaatgattttttgccagaagtaaggagcccgcatttcctgaatcagaatt

SEQ ID NO: 369234 - DNA, 355 bp, Homo sapiens
ggcacaatcacagctccttggagcctcgaactcctgggctcaaatgatcccacctcagccccccatttagttgagattacaggcacacaccaccatgcctggctaatttttcaaatttttttgtagagatggtgtctcactatgttagccaggctggccatgaagggatgttttaaaagtgaaacttgaaaaggcaaaccgcaccccgcaaccccaaaaaaaggcaaaaacccatcatcaaaaccagagtatagccagcatagtggctcacacctgtaatcccagcacttggggaggtgcaggtgggaggattgcttgagcacaggaatttgaaaccagcctgggcaacatagca

SEQ ID NO: 369235 - DNA, 423 bp, Homo sapiens
ccagagctcagtgcgtggtggccacctgtcggtttcacccttccccacccccatgttgacatacatgtctaatttttctctttgtttctctgaatattatcatccatgttgtcagatgaaaattattaaaacattttctatatctgagcatgggttcctatgcatgagattatgaaaaacactaataaacaatagttgaaaacctaaaacagcgtaagaggctactttgatgacttctagctgttatagaagatgttgagaagaacatggagaaaaattaagcctgtgcagaaaatctctatgccctaattggtgtatagtgatatctcattatggttttaatttgagttcactgctaatttttgccttcccttttgggttaggcagaaatttcttagatgtgacaccaaaagcatgatctat

SEQ ID NO: 369236 - DNA, 2063 bp, Homo sapiens
cccagagcaagccgattctctacacactgccttcccttcctgtaagactcatcaaaaaggcaccccaaccttgcatggatctgctgttggtattccttggggtgaagccagaagtcaggctttccacagagagacgggactacatggccacctgggaaggctagggagtcaaagggcctgaggaatgactacttccctccacaagggcattccctgccctgctctgcttcctgggggcttcagcaagccttccttctagagctcctagaaccctcccatggtcaacacaacagcagcccagacaatgagatgcaagaggcctgagctcacaggccattcaggtcttctagatgccttcttgaggctgcttgtggccacccacagacacttgtaaggaggagagaagtcagcctggcagagagactctgaaatgagggattagaggtgttcaaggagcaagagcttcagcctgaagacaagggagcagtccctgaagacgcttctactgagaggtctgccatggcctctcttggcctccaacttgtgggctacatcctaggccttctggggcttttgggcacactggttgccatgctgctccccagctggaaaacaagttcttatgtcggtgccagcattgtgacagcagttggcttctccaagggcctctggatggaatgtgccacacacagcacaggcatcacccagtgtgacatctatagcacccttctgggcctgcccgctgacatccaggctgcccaggccatgatggtgacatccagtgcaatctcctccctggcctgcattatctctgtggtgggcatgagatgcacagtcttctgccaggaatcccgagccaaagacagagtggcggtagcaggtggagtctttttcatccttggaggcctcctgggattcattcctgttgcctggaatcttcatgggatcctacgggacttctactcaccactggtgcctgacagcatgaaatttgagattggagaggctctttacttgggcattatttcttccctgttctccctgatagctggaatcatcctctgcttttcctgctcatcccagagaaatcgctccaactactacgatgcctaccaagcccaacctcttgccacaaggagctctccaaggcctggtcaacctcccaaagtcaagagtgagttcaattcctacagcctgacagggtatgtgtgaagaaccaggggccagagctggggggtggctgggtctgtgaaaaacagtggacagcaccccgagggccacaggtgagggacactaccactggatcgtgtcagaaggtgctgctgaggatagactgactttggccattggattgagcaaaggcagaaatgggggctagtgtaacagcatgcaggttgaattgccaaggatgctcgccatgccagcctttctgttttcctcaccttgctgctcccctgccctaagtccccaaccctcaacttgaaaccccattcccttaagccaggactcagaggatccctttgccctctggtttacctgggactccatccccaaacccactaatcacatcccactgactgaccctctgtgatcaaagaccctctctctggctgaggttggctcttagctcattgctggggatgggaaggagaagcagtggcttttgtgggcattgctctaacctacttctcaagcttccctccaaagaaactgattggccctggaacctccatcccactcttgttatgactccacagtgtccagactaatttgtgcatgaactgaaataaaaccatcctacggtatccagggaacagaaagcaggatgcaggatgggaggacaggaaggcagcctgggacatttaaaaaaataaaaatgaaaaaaaaacccagaacccatttctcagggcactttccagaattctctcatatttgtgggctgggatcaagcctgcagcttgaggaaagcacaaggaaaggaaagaagatctggtggaaagctcaggtggcagcggactctgactccactgaggaactgcctcagaagctgcgatcacaacttt

SEQ ID NO: 369237 - DNA, 945 bp, Homo sapiens
  misc_feature (5)..(5): n is a, c, g, or t
  misc_feature (23)..(23): n is a, c, g, or t
  misc_feature (902)..(903): n is a, c, g, or t
  misc_feature (906)..(906): n is a, c, g, or t
  misc_feature (908)..(908): n is a, c, g, or t
caatnaggctaggtacgaggccnggtgttaatcggccgaggccacagacacttgtaaggaggagagaagtcagcctggcagagagactctgaaatgagggattagaggtgttcaaggagcaagagcttcagcctgaagacaagggagcagtccctgaagacgcttctactgagaggtctgccatggcctctcttggcctccaacttgtgggctacatcctaggccttctggggcttttgggcacactggttgccatgctgctccccagctggaaaacaagttcttatgtcggtgccagcattgtgacagcagttggcttctccaagggcctctggatggaatgtgccacacacagcacaggcatcacccagtgtgacatctatagcacccttctgggcctgcccgctgacatccaggctgcccaggccatgatggtgacatccagtgcaatctcctccctggcctgcattatctctgtggtgggcatgagatgcacagtcttctgccaggaatcccgagccaaagacagagtggcggtagcaggtggagtctttttcatccttggaggcctcctgggattcattcctgttgcctggaatcttcatgggatcctacgggacttctactcaccactggtgcctgacagcatgaaatttgagattggagaggctctttacttgggcattatttcttccctgttctccctgatagctggaatcatcctctgcttttcctgctcatcccagagaaatcgctccaactactacgatgcctaccaagcccaacctcttgccacaaggagctctccaaggcctggtcaacctcccaaagtcaagagtgagttcaattcctacagcctgacagggtatgtgtgaagaaccaggggccagagctgggggggnnggncnggaacagggacgccccggggcccgtgggacttcctgt

SEQ ID NO: 369238 - DNA, 809 bp, Homo sapiens
gagctgtggggtactgaggaagacaccattccttgacggtgtctaagaagccaggtggatgtgtgtggtggctccagtgggtgtttctactctgccagtgagaggcagccccctagaaactcttcaggcgtaatggaaaatcagctcaaatgagatcaggcccccccagggtccacccacagagcactacagagcctctgaaagaccatagcaccaagcgagccccttcagattcccccactgtccatcggaagatgctccagagtggctagagggcatctaagggctccagcatggcatatccatgcccacggtgctgtgtccatgatctgagtgatagctgcactgctgcctgggattgcagctgaggtgggagtggagaatggttcccaggaagacagttccacctctaaggtccgaaaatgttccctttaccctggagtgggagtgaggggtcatacaccaaaggtattttccctcaccagtctaggcatgactggcttctgaaaaattccagcacacctcctcgaacctcattgtcagcagagagggactttgttcaggaagaaatccgtgtctccaacgaatatctacccatcacagacccctttcctatcactcaaggccccaggctggaacaaaatggatgcataacagttctgtgtacttgccaaggcatgtgggtgtgggtgccatgtgggtggtttacacacatgcctaccaggtatggcgtgactgtgtgtgtgtgcatggggtgtacaagcaagtgtctacctatgtgtctttctgggcaatgtgtaccatctgtg

SEQ ID NO: 369239 - DNA, 1261 bp, Homo sapiens
  misc_feature (5)..(5): n is a, c, g, or t
  misc_feature (23)..(23): n is a, c, g, or t
caatnaggctaggtacgaggccnggtgttaatcggccgaggccacagacacttgtaaggaggagagaagtcagcctggcagagagactctgaaatgagggattagaggtgttcaaggagcaagagcttcagcctgaagacaagggagcagtccctgaagacgcaccactggtgcctgacagcatgaaatttgagattggagaggctctttacttgggcattatttcttccctgttctccctgatagctggaatcatcctctgcttttcctgctcatcccagagaaatcgctccaactactacgatgcctaccaagcccaacctcttgccacaaggagctctccaaggcctggtcaacctcccaaagtcaagagtgagttcaattcctacagcctgacagggtatgtgtgaagaaccaggggccagagctggggggtggctgggtctgtgaaaaacagtggacagcaccccgagggccacaggtgagggacactaccactggatcgtgtcagaaggtgctgctgaggatagactgactttggccattggattgagcaaaggcagaaatgggggctagtgtaacagcatgcaggttgaattgccaaggatgctcgccatgccagcctttctgttttcctcaccttgctgctcccctgccctaagtccccaaccctcaacttgaaaccccattcccttaagccaggactcagaggatccctttgccctctggtttacctgggactccatccccaaacccactaatcacatcccactgactgaccctctgtgatcaaagaccctctctctggctgaggttggctcttagctcattgctggggatgggaaggagaagcagtggcttttgtgggcattgctctaacctacttctcaagcttccctccaaagaaactgattggccctggaacctccatcccactcttgttatgactccacagtgtccagactaatttgtgcatgaactgaaataaaaccatcctacggtatccagggaacagaaagcaggatgcaggatgggaggacaggaaggcagcctgggacatttaaaaaaataaaaatgaaaaaaaaacccagaacccatttctcagggcactttccagaattctctcatatttgtgggctgggatcaagcctgcagcttgaggaaagcacaaggaaaggaaagaagatctggtggaaagctcaggtggcagcggactctgactccactgaggaactgcctcagaagctgcgatcacaacttt

SEQ ID NO: 369240 - DNA, 701 bp, Homo sapiens
ggagcccttagatcatggacacagcatggcatatccatgcccacggtgctatcactcagatcatggacacagcaccgtgggcatggatatgccatgctgcactgctgcctgggattgcagctgaggtgggagtggagaatggttcccaggaagacagttccacctctaaggtccgaaaatgttccctttaccctggagtgggagtgaggggtcatacaccaaaggtattttccctcaccagtctaggcatgactggcttctgaaaaattccagcacacctcctcgaacctcattgtcagcagagagggcccatctgttgtctgtaacatgcctttcacatgtccaccttcttgccatgttccagctgctctcccaacctggaaggccgtctccccttagccaagtcctcctcaggcttggagaacttcctcagcgtcacctccttcattgagccttctctgatcactccatccctctcctacccctccctcccccaaccctcaatgtataaattgcttcttgatgcttagcattcacaatttttgattgatcgttatttgtgtgtgtgtgtccgatctcacaagtatattgtaaacccttcggtgggtgggggccatatcctagacctctctgtatcccccagactatctgtaacagtgccaggcacacagtaggtgatcaataaacacttgttgattgag

SEQ ID NO: 369241 - DNA, 755 bp, Homo sapiens
tcaaacagcagcaccaccagctccttaactgccttatcattcttttcgcgctcagccgtctgccgcagcgtctccacaatgggctggtcaggcttgatctccaggtgctttttgcccatcatatagccattggtggagttgtcccgaagtgcctgggctttctctctcaactcccgggagtgggagtggagaatggttcccaggaagacagttccacctctaaggtccgaaaatgttccctttaccctggagtgggagtgaggggtcatacaccaaaggtattttccctcaccagtctaggcatgactggcttctgaaaaattccagcacacctcctcgaacctcattgtcagcagagagggcccatctgttgtctgtaacatgcctttcacatgtccaccttcttgccatgttccagctgctctcccaacctggaaggccgtctccccttagccaagtcctcctcaggcttggagaacttcctcagcgtcacctccttcattgagccttctctgatcactccatccctctcctacccctccctcccccaaccctcaatgtataaattgcttcttgatgcttagcattcacaatttttgattgatcgttatttgtgtgtgtgtgtccgatctcacaagtatattgtaaacccttcggtgggtgggggccatatcctagacctctctgtatcccccagactatctgtaacagtgccaggcacacagtaggtgatcaataaacacttgttgattgag

SEQ ID NO: 369242 - DNA, 945 bp, Homo sapiens
gagctgtggggtactgaggaagacaccattccttgacggtgtctaagaagccaggtggatgtgtgtggtggctccagtgggtgtttctactctgccagtgagaggcagccccctagaaactcttcaggcgtaatggaaaatcagctcaaatgagatcaggcccccccagggtccacccacagagcactacagagcctctgaaagaccatagcaccaagcgagccccttcagattcccccactgtccatcggaagatgctccagagtggctagagggcatctaagggctccagcatggcatatccatgcccacggtgctgtgtccatgatctgagtgatagctgcactgctgcctgggattgcagctgaggtgggagtggagaatggttcccaggaagacagttccacctctaaggtccgaaaatgttccctttaccctggagtgggagtgaggggtcatacaccaaaggtattttccctcaccagtctaggcatgactggcttctgaaaaattccagcacacctcctcgaacctcattgtcagcagagagggcccatctgttgtctgtaacatgcctttcacatgtccaccttcttgccatgttccagctgctctcccaacctggaaggccgtctccccttagccaagtcctcctcaggcttggagaacttcctcagcgtcacctccttcattgagccttctctgatcactccatccctctcctacccctccctcccccaaccctcaatgtataaattgcttcttgatgcttagcattcacaatttttgattgatcgttatttgtgtgtgtgtgtccgatctcacaagtatattgtaaacccttcggtgggtgggggccatatcctagacctctctgtatcccccagactatctgtaacagtgccaggcacacagtaggtgatcaataaacacttgttgattgag

SEQ ID NO: 369243 - DNA, 1245 bp, Homo sapiens
ggagcccttagatcatggacacagcatggcatatccatgcccacggtgctatcactcagatcatggacacagcaccgtgggcatggatatgccatgctgcactgctgcctgggattgcagctgaggtgggagtggagaatggttcccaggaagacagttccacctctaaggtccgaaaatgttccctttaccctggagtgggagtgaggggtcatacaccaaaggtattttccctcaccagtctaggcatgactggcttctgaaaaattccagcacacctcctcgaacctcattgtcagcagagagggcccatctgttgtctgtaacatgcctttcacatgtccaccttcttgccatgttccagctgctctcccaacctggaaggccgtctccccttagccaagtcctcctcaggcttggagaacttcctcagcgtcacctccttcattgagccttctctgatcactccatccctctcctacccctccctcccccaaccctcaatgtataaattgcttcttgatgcttagcattcacaatttttgattgatcgttatttgtgtgtgtgtgtccgatctcacaagtatattgtaaacccttcggtgggtgggggccatatcctagacctctctgtatcccccagactatctgtaacagtgccaggcacacagtaggtgatcaataaacacttgttgattgagaaaaaaaaaaaaagaagcaaagaaaaaaaaaacaacaacaaaaaaaaaaagaaaaaaaacaataaaaaaaagaggggcggggcgcgccacaaaaaatatttcctcctgcgggggggcccaccagtatctagtgctgccccccggatggttcttctgtgagcaacaagcgggggctgccaccattaaggggaggcagttttaatacgaccaccggaacacggggcggcgcggggttaaaaccaaggccgtcggcggcgggcggcaacaccacgcgctcaacgcgcgaggcattatcgggcgggaagagacagacccccaacacacggcgggggggcgggaacacacaatcgtcggcaacacatcttccccgcagcagagaagaatatagaacagaccccccggacggcaaaaacacaaacaaccctgcgaccgcgagtgacgagcgggcggaacacccaccgccgccgcataaatcgagccgcccgcttgaaaaaactcgacggccccaagacgacagaaacaatctgaccaaacaacactttcc

SEQ ID NO: 369244 - DNA, 806 bp, Homo sapiens
  misc_feature (5)..(5): n is a, c, g, or t
  misc_feature (23)..(23): n is a, c, g, or t
caatnaggctaggtacgaggccnggtgttaatcggccgaggccacagacacttgtaaggaggagagaagtcagcctggcagagagactctgaaatgagggattagaggtgttcaaggagcaagagcttcagcctgaagacaagggagcagtccctgaagacgcttctactgagaggtctgccatggcctctcttggcctccaacttgtgggctacatcctaggccttctggggcttttgggcacactggttgccatgctgctccccagctggaaaacaagttcttatgtcggtgccagcattgtgacagcagttggcttctccaagggcctctggatggaatgtgccacacacagcacaggcatcacccagtgtgacatctatagcacccttctgggcctgcccgctgacatccaggctgcccaggccatgatggtgacatccagtgcaatctcctccctggcctgcattatctctgtggtgggcatgagatgcacagtcttctgccaggaatcccgagccaaagacagagtggcggtagcaggtggagtctttttcatccttggaggcctcctgggattcattcctgttgcctggaatcttcatgggatcctacgggacttctactatgcttagcattcacaatttttgattgatcgttatttgtgtgtgtgtgtccgatctcacaagtatattgtaaacccttcggtgggtgggggccatatcctagacctctctgtatcccccagactatctgtaacagtgccaggcacacagtaggtgatcaataaacacttgttgattgag

SEQ ID NO: 369245 - DNA, 1480 bp, Homo sapiens
  misc_feature (5)..(5): n is a, c, g, or t
  misc_feature (23)..(23): n is a, c, g, or t
caatnaggctaggtacgaggccnggtgttaatcggccgagggtcggtgccagcattgtgacagcagttggcttctccaagggcctctggatggaatgtgccacacacagcacaggcatcacccagtgtgacatctatagcacccttctgggcctgcccgctgacatccaggctgcccaggccatgatggtgacatccagtgcaatctcctccctggcctgcattatctctgtggtgggcatgagatgcacagtcttctgccaggaatcccgagccaaagacagagtggcggtagcaggtggagtctttttcatccttggaggcctcctgggattcattcctgttgcctggaatcttcatgggatcctacgggacttctactcaccactggtgcctgacagcatgaaatttgagattggagaggctctttacttgggcattatttcttccctgttctccctgatagctggaatcatcctctgcttttcctgctcatcccagagaaatcgctccaactactacgatgcctaccaagcccaacctcttgccacaaggagctctccaaggcctggtcaacctcccaaagtcaagagtgagttcaattcctacagcctgacagggtatgtgtgaagaaccaggggccagagctggggggtggctgggtctgtgaaaaacagtggacagcaccccgagggccacaggtgagggacactaccactggatcgtgtcagaaggtgctgctgaggatagactgactttggccattggattgagcaaaggcagaaatgggggctagtgtaacagcatgcaggttgaattgccaaggatgctcgccatgccagcctttctgttttcctcaccttgctgctcccctgccctaagtccccaaccctcaacttgaaaccccattcccttaagccaggactcagaggatccctttgccctctggtttacctgggactccatccccaaacccactaatcacatcccactgactgaccctctgtgatcaaagaccctctctctggctgaggttggctcttagctcattgctggggatgggaaggagaagcagtggcttttgtgggcattgctctaacctacttctcaagcttccctccaaagaaactgattggccctggaacctccatcccactcttgttatgactccacagtgtccagactaatttgtgcatgaactgaaataaaaccatcctacggtatccagggaacagaaagcaggatgcaggatgggaggacaggaaggcagcctgggacatttaaaaaaataaaaatgaaaaaaaaacccagaacccatttctcagggcactttccagaattctctcatatttgtgggctgggatcaagcctgcagcttgaggaaagcacaaggaaaggaaagaagatctggtggaaagctcaggtggcagcggactctgactccactgaggaactgcctcagaagctgcgatcacaacttt

SEQ ID NO: 369246 - DNA, 1576 bp, Homo sapiens
  misc_feature (5)..(5): n is a, c, g, or t
  misc_feature (23)..(23): n is a, c, g, or t
caatnaggctaggtacgaggccnggtgttaatcggccgaggccacagacacttgtaaggaggagagaagtcagcctggcagagagactctgaaatgagggattagaggtgttcaaggagcaagagcttcagcctgaagacaagggagcagtccctgaagacgcttctactgagaggtctgccatggcctctcttggcctccaacttgtgggctacatcctaggccttctggggcttttgggcacactggttgccatgctgctccccagctggaaaacaagttcttatgtcggtgccagcattgtgacagcagttggcttctccaagggcctctggatggaatgtgccacacacagcacaggcatcacccagtgtgacatctatagcacccttctgggcctgcccgctgacatccaggctgcccaggccatgatggtgacatccagtgcaatctcctccctggcctgcattatctctgtggtgggcatgagatgcacagtcttctgccaggaatcccgagccaaagacagagtggcggtagcaggtggagtctttttcatccttggaggcctcctgggattcattcctgttgcctggaatcttcatgggatcctacgggacttctactcaccactggtgcctgacagcatgaaatttgagattggagaggctctttacttgggcattatttcttccctgttctccctgatagctggaatcatcctctgcttttcctgctcatcccagagaaatcgctccaactactacgatgcctaccaagcccaacctcttgccacaaggagctctccaaggcctggtcaacctcccaaagtcaagagtgagttcaattcctacagcctgacagggtatgtgtgaagaaccaggggccagagctggggggtggctgggtctgtgaaaaacagtggacagcaccccgagggccacaggtgagggacactaccactggatcgtgtcagaaggtgctgctgaggatagactgactttggccattggattgagcaaaggcagaaatgggggctagtgtaacagcatgcaggttgaattgccaaggatgctcgccatgccagcctttctgttttcctcaccttgctgctcccctgccctaagtccccaaccctcaacttgaaaccccattcccttaagccaggactcagaggatccctttgccctctggtttacctgggactccatccccaaacccactaatcacatcccactgactgaccctctgtgatcaaagaccctctctctggctgaggttggctcttagctcattgctggggatgggaaggagaagcagtggcttttgtgggcattgctctaacctacttctcaagcttcccctcccccaaccctcaatgtataaattgcttcttgatgcttagcattcacaatttttgattgatcgttatttgtgtgtgtgtgtccgatctcacaagtatattgtaaacccttcggtgggtgggggccatatcctagacctctctgtatcccccagactatctgtaacagtgccaggcacacagtaggtgatcaataaacacttgttgattgag

SEQ ID NO: 369247 - DNA, 946 bp, Homo sapiens
  misc_feature (5)..(5): n is a, c, g, or t
  misc_feature (23)..(23): n is a, c, g, or t
caatnaggctaggtacgaggccnggtgttaatcggccgaggccacagacacttgtaaggaggagagaagtcagcctggcagagagactctgaaatgagggattagaggtgttcaaggagcaagagcttcagcctgaagacaagggagcagtccctgaagacgcttctactgagaggtctgccatggcctctcttggcctccaacttgtgggctacatcctaggccttctggggcttttgggcacactggttgccatgctgctccccagctggaaaacaagttcttatgtcggtgccagcattgtgacagcagttggcttctccaagggcctctggatggaatgtgccacacacagcacaggcatcacccagtgtgacatctatagcacccttctgggcctgcccgctgacatccaggctgcccaggccatgatggtgacatccagtgcaatctcctccctggcctgcattatctctgtggtgggcatgagatgcacagtcttctgccaggaatcccgagccaaagacagagtggcggtagcaggtggagtctttttcatccttggaggcctcctgggattcattcctgttgcctggaatcttcatgggatcctacgggacttctactcaccactggtgcctgacagcatgaaatttgagattggagaggctctttacttgggcattatttcttccctgttctccctgatagtccatccctctcctacccctccctcccccaaccctcaatgtataaattgcttcttgatgcttagcattcacaatttttgattgatcgttatttgtgtgtgtgtgtccgatctcacaagtatattgtaaacccttcggtgggtgggggccatatcctagacctctctgtatcccccagactatctgtaacagtgccaggcacacagtaggtgatcaataaacacttgttgattgag

SEQ ID NO: 369248 - DNA, 595 bp, Homo sapiens
cttggcaatgtattaaacagcaggccttggagactagcacttgagttaacacagccaccacaaccaccactgccatcatcaccttcccggaaagcagccacctgtctggctcctggctttgtccagctgccaacctaaggcatgtgcctacgcaggaggcgatgacattttggctccacgttcaaagttgttttttttttcctttctcatgtgttatttctaaagataacaaaggtcaaaaggcatccagcgttttctggtttctcataagcttctggtcaatatttaatctggtttatggattttttttaggtcttctagatgccttcttgaggctgcttgtggccacccacagacacttgtaaggaggagagaagtcagcctggcagagagactctgaaatgagggattagaggtgttcaaggagcaagagcttcagcctgaagacaagggagcagtccctgaagacgcttctactgagaggtctgccatggcctctcttggcctccaacttgtgggctacatcctaggccttctggggcttttgggcacactggttgccatgctgctccccagctggaaaacaagttcttat

SEQ ID NO: 369249 - DNA, 1505 bp, Homo sapiens
gaccacatatgctaggtcgatgccggctgtgatgcttgagatcggctgaagagagcgggcccaggctctgtgaggaggcaagggaggtgagaaccttgctctcagagggtgactcaagtcaacacagggaacccctcttttctacagacacagtgggtcgcaggatctgacaagagtccaggttctcaggggacagggagagcaagaggtcaagagctgtgggacaccacagagcagcactgaaggagaagacctgcctgtgggtccccatcgcccaagtcctgcccacactcccacctgctaccctgatcagagtcatcatgcctcgagctccaaagcgtcagcgctgcatgcctgaagaagatcttcaatcccaaagtgagacacagggcctcgagggtgcacaggctcccctggctgtggaggaggatgcttcatcatccacttccaccagctcctcttttccatcctcttttccctcctcctcctcttcctcctcctcctcctgctatcctctaataccaagcaccccagaggaggtttctgctgatgatgagacaccaaatcctccccagagtgctcagatagcctgctcctccccctcggtcgttgcttcccttccattagatcaatctgatgagggctccagcagccaaaaggaggagagtccaagcaccctacaggtcctgccagacagtgagtctttacccagaagtgagatagatgaaaaggtgactgatttggtgcagtttctgctcttcaagtatcaaatgaaggagccgatcacaaaggcagaaatactggagagtgtcataaaaaattatgaagaccacttccctttgttgtttagtgaagcctccgagtgcatgctgctggtctttggcattgatgtaaaggaagtggatcccactggccactcctttgtccttgtcacctccctgggcctcacctatgatgggatgctgagtgatgtccagagcatgcccaagactggcattctcatacttatcctaagcataatcttcatagagggctactgcacccctgaggaggtcatctgggaagcactgaatatgatggggctgtatgatgggatggagcacctcatttatggggagcccaggaagctgctcacccaagattgggtgcaggaaaactacctggagtaccggcaggtgcctggcagtgatcctgcacggtatgagtttctgtggggtccaagggctcatgctgaaattaggaagatgagtctcctgaaatttttggccaaggtaaatgggagtgatccaagatccttcccactgtggtatgaggaggctttgaaagatgaggaagagagagcccaggacagaattgccaccacagatgatactactgccatggccagtgcaagttctagcgctacaggtagcttctcctaccctgaataaagtaagacagattcttcactgtgttttaaaaggcaagtcaaataccacatgattttactcatatgtggaatctaa

SEQ ID NO: 369250 - DNA, 1521 bp, Homo sapiens
ggacgcgtgggtcgacccacgcgtccgaggttctcgttctgagggacaggcttgagatcggctgaagagagcgggcccaggctctgtgaggaggcaagggaggtgagaaccttgctctcagagggtgactcaagtcaacacagggaacccctcttttctacagacacagtgggtcgcaggatctgacaagagtccaggttctcaggggacagggagagcaagaggtcaagagctgtgggacaccacagagcagcactgaaggagaagacctgcctgtgggtccccatcgcccaagtcctgcccacactcccacctgctaccctgatcagagtcatcatgcctcgagctccaaagcgtcagcgctgcatgcctgaagaagatcttcaatcccaaagtgagacacagggcctcgagggtgcacaggctcccctggctgtggaggaggatgcttcatcatccacttccaccagctcctcttttccatcctcttttccctcctcctcctcttcctcctcctcctcctgctatcctctaataccaagcaccccagaggaggtttctgctgatgatgagacaccaaatcctccccagagtgctcagatagcctgctcctccccctcggtcgttgcttcccttccattagatcaatctgatgagggctccagcagccaaaaggaggagagtccaagcaccctacaggtcctgccagacagtgagtctttacccagaagtgagatagatgaaaaggtgactgatttggtgcagtttctgctcttcaagtatcaaatgaaggagccgatcacaaaggcagaaatactggagagtgtcataaaaaattatgaagaccacttccctttgttgtttagtgaagcctccgagtgcatgctgctggtctttggcattgatgtaaaggaagtggatcccactggccactcctttgtccttgtcacctccctgggcctcacctatgatgggatgctgagtgatgtccagagcatgcccaagactggcattctcatacttatcctaagcataatcttcatagagggctactgcacccctgaggaggtcatctgggaagcactgaatatgatggggctgtatgatgggatggagcacctcatttatggggagcccaggaagctgctcacccaagattgggtgcaggaaaactacctggagtaccggcaggtgcctggcagtgatcctgcacggtatgagtttctgtggggtccaagggctcatgctgaaattaggaagatgagtctcctgaaatttttggccaaggtaaatgggagtgatccaagatccttcccactgtggtatgaggaggctttgaaagatgaggaagagagagcccaggacagaattgccaccacagatgatactactgccatggccagtgcaagttctagcgctacaggtagcttctcctaccctgaataaagtaagacagattcttcactgtgttttaaaaggcaagtcaaataccacatgattttactcatatgtggaatctaa

SEQ ID NO: 369251 - DNA, 391 bp, Homo sapiens
gcgcaactccgtctcaaaaaataataataataaaataaaataaatttgtattttattacaatagcatttgcagataggaaactcgtgcttattattccttttatgaatttattgacttatggaatgcctaatatgtagcaggcactgaggtaggcactgaagacacacaggtaaaaccaatacggcgcctgacctcatcgagcacagatacatgcaagatgtgctatttattgtgtctacagacaatgctcacaggtggatgggagcaccctgtctctgactcctcagaattagcagttgcttccttctttagccagcaaacttctgctgtatacattataaacaaacacacaggtcaggaataatacttggttaccagtaatgtgataaa

SEQ ID NO: 369252 - DNA, 768 bp, Homo sapiens
gtgacctttgatagaccttttctgtaatatgggagaaagaataaaattaaattgttttaaatgagataggaagtgaaaaataacctggtacatcccttttgcctcttaaaacctttttatattcaagtaatgtttctatacttgtggatattctgttagacatggttatctcattcacatttaaatgcctagaagccttttttatagctgttgtaaaagtttgtctttattagccatatgtattacaatggtggttggtttatacacatttttaaccttataataatagctacacacagacctactgaaggagcaaaagaaatattaaaattttacgtctaaaaaataagttttattagtgaatatcaagttttgatttgtttatgaaaggcattcagagacctgtgcaataattaaatttttttttcctccccagaattacctctggactacaaatttacaagattctcttcaagcaattcaaaaacagctggctactatccaaatcctccactggtcttatcaagtgatgagacactgatatccaaataagttgtctttactgaaaaatgaagtgaagacccatatatgcagttaaaaaaaagttaattttcaaaaaatactgtaaaagactttaaggaacaagttttattgaccaataagttgatatttgtccataggtctcctttctataaatcatcttgatgtttaacaactcttattatattaaaatctcagtatcctaaaaatagaaccttattgatattt

SEQ ID NO: 369253 - DNA, 693 bp, Homo sapiens
  misc_feature (9)..(9): n is a, c, g, or t
tgggagggngggaaatggaataaccgagcttgcagcacacgcagcaccagtcatgtggtgagcccctctgagctggcgcctcgtgcctcagaatcaggtagactcttgttataagattacagttacccttaactactcccaagggaacgctgtccacctctatgaacttctgaagaaaatgactggcaaacctgaacccaaggttgtttattttggtgacagcatgcattcagatattttcccagctcgtcactatagtaattgggagacagtcctcatcctggaagaactcagaggggatgaaggcacgaggagtcagaggcctgaggagtcagagcctctagagaagaaaggaaaatatgagggaccaaaagcaaaacctttaaatacttcatctaaaaaatggggctctttttttattgattcagttttgggactggaaaatacagaagactccttggtttatacatggtcttgtaagagaatcagtacttacagcactattgcaattccaagtattgaagcaatcgcagaattacctctggactacaaatttacaagattctcttcaagcaattcaaaaacagctggctactatccaaatcctccactggtcttatcaagtgatgagacactgatatccaaataagttgtctttactgaaaaatgaagtgaagacccatatatgcagtt

SEQ ID NO: 369254 - DNA, 1671 bp, Homo sapiens
cggcccggtcctgtcccgcagcgtcccgccagccagctccttgcacccttcgcggccgaggcgctccctggtgctccccgcgcagccatggctcagcacttctccctggccgcctgcgacgtggtcggattcgacctggaccacactctgtgtcgctacaacctgcccgagagcgccccgctcatttataatagctttgcccagttcctagttaaggagaaagggtacgataaggaattgctcaatgtgaccccagaggattgggatttctgttgcaaaggtttggcattggatctagaagatgggaacttccttaaacttgcaaataatggcactgttctcagggcaagccatggcaccaagatgatgactccagaggtgctggcagaggcatatggcaagaaagagtggaagcacttcttgtcggacactggaatggcttgccgctcaggaaagtattacttttacgacaactactttgacctgccaggagctcttctgtgtgccagggtggtggactatttaacaaaactgaacaatggtcaaaaaacatttgatttttggaaggatatagttgctgctatacaacacaattataaaatgtcagcttttaaggaaaactgtggaatatattttccagaaataaaaagagatccaggcagatatttacatagttgtcctgaatctgtgaaaaaatggcttcgacagctaaagaatgctgggaaaattcttctgttaattaccagttctcacagtgattactgtagacttctctgcgaatatattcttgggaatgattttacagacctttttgacattgtgattacaaatgcattgaagcctggtttcttctcccacttaccaagtcagagacctttccggacactcgagaatgatgaggagcaggaggcactgccatctctggataaacctggctggtactcccaagggaacgctgtccacctctatgaacttctgaagaaaatgactggcaaacctgaacccaaggttgtttattttggtgacagcatgcattcagatattttcccagctcgtcactatagtaattgggagacagtcctcatcctggaagaactcagaggggatgaaggcacgaggagtcagaggcctgaggagtcagagcctctagagaagaaaggaaaatatgagggaccaaaagcaaaacctttaaatacttcatctaaaaaatggggctctttttttattgattcagttttgggactggaaaatacagaagactccttggtttatacatggtcttgtaagagaatcagtacttacagcactattgcaattccaagtattgaagcaatcgcagaattacctctggactacaaatttacaagattctcttcaagcaattcaaaaacagctggctactatccaaatcctccactggtcttatcaagtgatgagacactgatatccaaataagttgtctttactgaaaaatgaagtgaagacccatatatgcagttaaaaaaaagttaattttcaaaaaatactgtaaaagactttaaggaacaagttttattgaccaataagttgatatttgtccataggtctcctttctataaatcatcttgatgtttaacaactcttattatattaaaatctcagtatcctaaaaatagaaccttattgatattt

SEQ ID NO: 369255 - DNA, 1647 bp, Homo sapiens
cggcccggtcctgtcccgcagcgtcccgccagccagctccttgcacccttcgcggccgaggcgctccctggtgctccccgcgcagccatggctcagcacttctccctggccgcctgcgacgtggtcggattcgacctggaccacactctgtgtcgctacaacctgcccgagagcgccccgctcatttataatagctttgcccagttcctagttaaggagaaagggtacgataaggaattgctcaatgtgaccccagaggattgggatttctgttgcaaaggtttggcattggatctagaagatgggaacttccttaaacttgcaaataatggcactgttctcagggcaagccatggcaccaagatgatgactccagaggtgctggcagaggcatatggcaagaaagagtggaagcacttcttgtcggacactggaatggcttgccgctcaggaaagtattacttttacgacaactactttgacctgccaggagctcttctgtgtgccagggtggtggactatttaacaaaactgaacaatggtcaaaaaacatttgatttttggaaggatatagttgctgctatacaacacaattataaaatgtcagcttttaaggaaataaaaagagatccaggcagatatttacatagttgtcctgaatctgtgaaaaaatggcttcgacagctaaagaatgctgggaaaattcttctgttaattaccagttctcacagtgattactgtagacttctctgcgaatatattcttgggaatgattttacagacctttttgacattgtgattacaaatgcattgaagcctggtttcttctcccacttaccaagtcagagacctttccggacactcgagaatgatgaggagcaggaggcactgccatctctggataaacctggctggtactcccaagggaacgctgtccacctctatgaacttctgaagaaaatgactggcaaacctgaacccaaggttgtttattttggtgacagcatgcattcagatattttcccagctcgtcactatagtaattgggagacagtcctcatcctggaagaactcagaggggatgaaggcacgaggagtcagaggcctgaggagtcagagcctctagagaagaaaggaaaatatgagggaccaaaagcaaaacctttaaatacttcatctaaaaaatggggctctttttttattgattcagttttgggactggaaaatacagaagactccttggtttatacatggtcttgtaagagaatcagtacttacagcactattgcaattccaagtattgaagcaatcgcagaattacctctggactacaaatttacaagattctcttcaagcaattcaaaaacagctggctactatccaaatcctccactggtcttatcaagtgatgagacactgatatccaaataagttgtctttactgaaaaatgaagtgaagacccatatatgcagttaaaaaaaagttaattttcaaaaaatactgtaaaagactttaaggaacaagttttattgaccaataagttgatatttgtccataggtctcctttctataaatcatcttgatgtttaacaactcttattatattaaaatctcagtatcctaaaaatagaaccttattgatattt

SEQ ID NO: 369256 - DNA, 1499 bp, Homo sapiens
cggcccggtcctgtcccgcagcgtcccgccagccagctccttgcacccttcgcggccgaggcgctccctggtgctccccgcgcagccatggctcagcacttctccctggccgcctgcgacgtggtcggattcgacctggaccacactctgtgtcgctacaacctgcccgagagcgccccgctcatttataatagctttgcccagttcctagttaaggagaaagggtacgataaggaattgctcaatgtgaccccagaggattgggatttctgttgcaaaggtttggcattggatctagaagatgggaacttccttaaacttgcaaataatggcactgttctcagggcaagccatggcaccaagatgatgactccagaggtgctggcagaggcatatggcaagaaagagtggaagcacttcttgtcggacactggaatggcttgccgctcaggaaagtattacttttacgacaactactttgacctgccaggagctcttctgtgtgccagggtggtggactatttaacaaaactgaacaatggtcaaaaaacatttgatttttggaaggatatagttgctgctatacaacacaattataaaatgtcagcttttaaggaaaactgtggaatatattttccagaaataaaaagagatccaggcagatatttacatagttgtcctgaatctgtgaaaaaatggcttcgacagctaaagaatgctgggaaaattcttctgttaattaccagttctcacagtgattactgtagacttctctgcgaatatattcttgggaatgattttacagacctttttgacattgtgattacaaatgcattgaagcctggtttcttctcccacttaccaagtcagagacctttccggacactcgagaatgatgaggagcaggaggcactgccatctctggataaacctggctggtactcccaagggaacgctgtccacctctatgaacttctgaagaaaatgactggcaaacctgaacccaaggttgtttattttggtgacagcatgcattcagatattttcccagctcgtcactatagtaattgggagacagtcctcatcctggaagaactcagaggggatgaaggcacgaggagtcagaggcctgaggagtcagagcctctagagaagaaaggaaaatatgagggaccaaaagcaaaacctttaaatacttcatctaaaaaatggggctctttttttattgattcagttttgggactggaaaatacagaagactccttggtttatacatggtcttgtaagagaatcagtacttacagcactattgcaattccaagtattgaagcaatcgcagaattacctctggactacaaatttacaagattctcttcaagcaattcaaaaacagctggctactatccaaatcctccactggtcttatcaagtgatgagacactgatatccaaataagttgtctttactgaaaaatgaagtgaagacccatatatgcagtt

SEQ ID NO: 369257 - DNA, 1671 bp, Homo sapiens
  misc_feature (1149)..(1149): n is a, c, g, or t
  misc_feature (1153)..(1154): n is a, c, g, or t
  misc_feature (1157)..(1157): n is a, c, g, or t
  misc_feature (1162)..(1163): n is a, c, g, or t
  misc_feature (1182)..(1182): n is a, c, g, or t
  misc_feature (1184)..(1184): n is a, c, g, or t
  misc_feature (1191)..(1191): n is a, c, g, or t
  misc_feature (1193)..(1193): n is a, c, g, or t
  misc_feature (1195)..(1195): n is a, c, g, or t
  misc_feature (1200)..(1200): n is a, c, g, or t
  misc_feature (1205)..(1205): n is a, c, g, or t
  misc_feature (1207)..(1207): n is a, c, g, or t
  misc_feature (1233)..(1233): n is a, c, g, or t
  misc_feature (1242)..(1242): n is a, c, g, or t
  misc_feature (1247)..(1248): n is a, c, g, or t
  misc_feature (1252)..(1252): n is a, c, g, or t
  misc_feature (1254)..(1254): n is a, c, g, or t
  misc_feature (1258)..(1259): n is a, c, g, or t
  misc_feature (1266)..(1266): n is a, c, g, or t
  misc_feature (1278)..(1278): n is a, c, g, or t
  misc_feature (1287)..(1289): n is a, c, g, or t
  misc_feature (1291)..(1291): n is a, c, g, or t
  misc_feature (1296)..(1297): n is a, c, g, or t
  misc_feature (1306)..(1307): n is a, c, g, or t
  misc_feature (1317)..(1317): n is a, c, g, or t
  misc_feature (1325)..(1325): n is a, c, g, or t
  misc_feature (1331)..(1331): n is a, c, g, or t
  misc_feature (1335)..(1335): n is a, c, g, or t
  misc_feature (1337)..(1338): n is a, c, g, or t
  misc_feature (1340)..(1340): n is a, c, g, or t
  misc_feature (1354)..(1354): n is a, c, g, or t
  misc_feature (1383)..(1389): n is a, c, g, or t
cggcccggtcctgtcccgcagcgtcccgccagccagctccttgcacccttcgcggccgaggcgctccctggtgctccccgcgcagccatggctcagcacttctccctggccgcctgcgacgtggtcggattcgacctggaccacactctgtgtcgctacaacctgcccgagagcgccccgctcatttataatagctttgcccagttcctagttaaggagaaagggtacgataaggaattgctcaatgtgaccccagaggattgggatttctgttgcaaaggtttggcattggatctagaagatgggaacttccttaaacttgcaaataatggcactgttctcagggcaagccatggcaccaagatgatgactccagaggtgctggcagaggcatatggcaagaaagagtggaagcacttcttgtcggacactggaatggcttgccgctcaggaaagtattacttttacgacaactactttgacctgccaggagctcttctgtgtgccagggtggtggactatttaacaaaactgaacaatggtcaaaaaacatttgatttttggaaggatatagttgctgctatacaacacaattataaaatgtcagcttttaaggaaaactgtggaatatattttccagaaataaaaagagatccaggcagatatttacatagttgtcctgaatctgtgaaaaaatggcttcgacagctaaagaatgctgggaaaattcttctgttaattaccagttctcacagtgattactgtagacttctctgcgaatatattcttgggaatgattttacagacctttttgacattgtgattacaaatgcattgaagcctggtttcttctcccacttaccaagtcagagacctttccggacactcgagaatgatgaggagcaggaggcactgccatctctggataaacctggctggtactcccaagggaacgctgtccacctctatgaacttctgaagaaaatgactggcaaacctgaacccaaggttgtttattttggtgacagcatgcattcagatattttcccagctcgtcactatagtaattgggagacagtcctcatcctggaagaactcagaggggatgaaggcacgaggagtcagaggcctgaggacccagaccccccngagnncanccccnnaaatgagggccccaacccnanccccccnancnccccnccccncnaatgggcccccccccccacccacccnccccccccnccccnnaacncncaannccccccnccccaaacacgnccccccaannnanccagnncccacagcnncatcgcaaanccaagtantgaggnaagngnngnatggcgtctggacnggggatttacaagattggcgtcagggggnnnnnnngcagctggctactatccaaatcctccactggtcttatcaagtgatgagacactgatatccaaataagttgtctttactgaaaaatgaagtgaagacccatatatgcagttaaaaaaaagttaattttcaaaaaatactgtaaaagactttaaggaacaagttttattgaccaataagttgatatttgtccataggtctcctttctataaatcatcttgatgtttaacaactcttattatattaaaatctcagtatcctaaaaatagaaccttattgatattt

SEQ ID NO: 369258 - DNA, 665 bp, Homo sapiens
cggcccggtcctgtcccgcagcgtcccgccagccagctccttgcacccttcgcggccgaggcgctccctggtgctccccgcgcagccatggctcagcacttctccctggccgcctgcgacgtggtcggattcgacctggaccacactctgtgtcgctacaacctgcccgagagcgccccgctcatttataatagctttgcccagttcctagttaaggagaaagggtacgataaggaattgctcaatgtgaccccagaggattgggatttctgttgcaaaggtttggcattggatctagaagatgggaacttccttaaacttgcaaataatggcactgttctcagggcaagccatggcaccaagatgatgactccagaggtgctggcagaggcatatggcaagaaagagtggaagcacttcttgtcggacactggaatggcttgccgctcaggaaagtattacttttacgacaactactttgacctgccaggagctcttctgtgtgccagggtggtggactatttaacaaaactgaacaatggtcaaaaaacatttctgtgggcagctgtagcacttacccgctttaatccatcaagtagcaggtgattaggagatactcactctgaggtaaacactggataagataccacccttttttgtcgacc

SEQ ID NO: 369259 - DNA, 288 bp, Homo sapiens
cagtggaatgttcaccttaaagtgtgtgagaaaaatataaagcatgtaaaagttagtcaaaagatgaatgatgctgtggtaaaatagataagcaaagatcaagttctgttttatatggaccttttctaattcttaaaataaacttatgaaaaattgtgttgcttttaggaatgattttacagacctttttgacattgtgattacaaatgcattgaagcctggtttcttctcccacttaccaagtcagagacctttccggacactcggtaagttacatttggtttcttt

SEQ ID NO: 369260 - DNA, 1852 bp, Homo sapiens
cggcccggtcctgtcccgcagcgtcccgccagccagctccttgcacccttcgcggccgaggcgctccctggtgctccccgcgcagccatggctcagcacttctccctggccgcctgcgacgtggtcggattcgacctggaccacactctgtgtcgctacaacctgcccgagagcgccccgctcatttataatagctttgcccagttcctagttaaggagaaagggtacgataaggaattgctcaatgtgaccccagaggattgggatttctgttgcaaaggtttggcattggatctagaagatgggaacttccttaaacttgcaaataatggcactgttctcagggcaagccatggcaccaagatgatgactccagaggtgctggcagaggcatatggcaagaaagagtggaagcacttcttgtcggacactggaatggcttgccgctcaggaaagtattacttttacgacaactactttgacctgccaggagctcttctgtgtgccagggtggtggactatttaacaaaactgaacaatggtcaaaaaacatttgatttttggaaggatatagttgctgctatacaacacaattataaaatgtcagcttttaaggaaaactgtggaatatattttccagaaataaaaagagatccaggcagatatttacatagttgtcctgaatctgtgaaaaaatggcttcgacagctaaagaatgctgggaaaattcttctgttaattaccagttctcacagtgattactgtagacttctctgcgaatatattcttgggaatgattttacagacctttttgacattgtgattacaaatgcattgaagcctggtttcttctcccacttaccaagtcagagacctttccggacactcgagaatgatgaggagcaggaggcactgccatctctggataaacctggctggtactcccaagggaacgctgtccacctctatgaacttctgaagaaaatgactggcaaacctgaacccaagaaaatatttaccagaatttctgtgagctgagagatcgtggggtaacagagccctgctccattggctgtcaccatgccacagtctcctggggactcctgagggttaatggatggagcagtctgacttgcagatgctgattctcatatcccttaactctgttttcacatctgaaaattgagaggttgtttattttggtgacagcatgcattcagatattttcccagctcgtcactatagtaattgggagacagtcctcatcctggaagaactcagaggggatgaaggcacgaggagtcagaggcctgaggagtcagagcctctagagaagaaaggaaaatatgagggaccaaaagcaaaacctttaaatacttcatctaaaaaatggggctctttttttattgattcagttttgggactggaaaatacagaagactccttggtttatacatggtcttgtaagagaatcagtacttacagcactattgcaattccaagtattgaagcaatcgcagaattacctctggactacaaatttacaagattctcttcaagcaattcaaaaacagctggctactatccaaatcctccactggtcttatcaagtgatgagacactgatatccaaataagttgtctttactgaaaaatgaagtgaagacccatatatgcagttaaaaaaaagttaattttcaaaaaatactgtaaaagactttaaggaacaagttttattgaccaataagttgatatttgtccataggtctcctttctataaatcatcttgatgtttaacaactcttattatattaaaatctcagtatcctaaaaatagaaccttattgatattt

SEQ ID NO: 369261 - DNA, 1828 bp, Homo sapiens
cggcccggtcctgtcccgcagcgtcccgccagccagctccttgcacccttcgcggccgaggcgctccctggtgctccccgcgcagccatggctcagcacttctccctggccgcctgcgacgtggtcggattcgacctggaccacactctgtgtcgctacaacctgcccgagagcgccccgctcatttataatagctttgcccagttcctagttaaggagaaagggtacgataaggaattgctcaatgtgaccccagaggattgggatttctgttgcaaaggtttggcattggatctagaagatgggaacttccttaaacttgcaaataatggcactgttctcagggcaagccatggcaccaagatgatgactccagaggtgctggcagaggcatatggcaagaaagagtggaagcacttcttgtcggacactggaatggcttgccgctcaggaaagtattacttttacgacaactactttgacctgccaggagctcttctgtgtgccagggtggtggactatttaacaaaactgaacaatggtcaaaaaacatttgatttttggaaggatatagttgctgctatacaacacaattataaaatgtcagcttttaaggaaataaaaagagatccaggcagatatttacatagttgtcctgaatctgtgaaaaaatggcttcgacagctaaagaatgctgggaaaattcttctgttaattaccagttctcacagtgattactgtagacttctctgcgaatatattcttgggaatgattttacagacctttttgacattgtgattacaaatgcattgaagcctggtttcttctcccacttaccaagtcagagacctttccggacactcgagaatgatgaggagcaggaggcactgccatctctggataaacctggctggtactcccaagggaacgctgtccacctctatgaacttctgaagaaaatgactggcaaacctgaacccaagaaaatatttaccagaatttctgtgagctgagagatcgtggggtaacagagccctgctccattggctgtcaccatgccacagtctcctggggactcctgagggttaatggatggagcagtctgacttgcagatgctgattctcatatcccttaactctgttttcacatctgaaaattgagaggttgtttattttggtgacagcatgcattcagatattttcccagctcgtcactatagtaattgggagacagtcctcatcctggaagaactcagaggggatgaaggcacgaggagtcagaggcctgaggagtcagagcctctagagaagaaaggaaaatatgagggaccaaaagcaaaacctttaaatacttcatctaaaaaatggggctctttttttattgattcagttttgggactggaaaatacagaagactccttggtttatacatggtcttgtaagagaatcagtacttacagcactattgcaattccaagtattgaagcaatcgcagaattacctctggactacaaatttacaagattctcttcaagcaattcaaaaacagctggctactatccaaatcctccactggtcttatcaagtgatgagacactgatatccaaataagttgtctttactgaaaaatgaagtgaagacccatatatgcagttaaaaaaaagttaattttcaaaaaatactgtaaaagactttaaggaacaagttttattgaccaataagttgatatttgtccataggtctcctttctataaatcatcttgatgtttaacaactcttattatattaaaatctcagtatcctaaaaatagaaccttattgatattt

SEQ ID NO: 369262 - DNA, 763 bp, Homo sapiens
cggcccggtcctgtcccgcagcgtcccgccagccagctccttgcacccttcgcggccgaggcgctccctggtgctccccgcgcagccatggctcagcacttctccctggccgcctgcgacgtggtcggattcgacctggaccacactctgtgtcgctacaacctgcccgagagcgccccgctcatttataatagctttgcccagttcctagttaaggagaaagggtacgataaggaattgctcaatgtgaccccagaggattgggatttctgttgcaaaggtttggcattggatctagaagatgggaacttccttaaacttgcaaataatggcactgttctcagggcaagccatggcaccaagatgatgactccagaggtgctggcagaggcatatggcaagaaagagtggaagcacttcttgtcggacactggaatggcttgccgctcaggaaagtattacttttacgacaactactttgacctgccaggagctcttctgtgtgccagggtggtggactatttaacaaaactgaacaatggtcaaaaaacatttgatttttggaaggatatagttgctgctatacaacacaattataaaatgtcagcttttaagggtaagtattgtgaagaggggccttctaatacgtgtttgttaagctatgtttgtctagtgaattagctgaaaagtaggtactttgctgtgtatcttacttaggatttaatttaagcttaaatattattataaagttggttctgactac

SEQ ID NO: 369263 - DNA, 468 bp, Homo sapiens
tcctcaaagctatgcaaacatccacttgcagattctacaaaaagagtgattcaaaactgctctatcaaaagaaaggttcaactctgttagttgagtacaaacatgacaaacaagtttctgagaatgattctgtctagtttttatgggaagatgtttcctcattcaccacaggcctcaaagcgctccaaatttccacttccggatactacaaaaagaatgtttcaaacctgctctatgaaagggaaggttcaaatctgtgacctgaatgcaaacatcagaaagaagtttctgcgaatgcttctgtctactttttatattggcattcccatttccaacgaaatcctcaaagctatccaaatatccacttgcagattctataaaaagattttttccaaactgttctatcaaaagaaaggttcaactctattagttgggtacacacataataaacaagtttctgagaatgct

SEQ ID NO: 369264 - DNA, 3587 bp, Homo sapiens
ttccatcccggcagtcgtggctgcagcgctgaggcgagaggttggtgggtgtctccggccataatgacccaggctgagaagggtgatacggagaacggaaaggagaagggcggcgagaaggagaaggagcagcgcggcgtgaagcggcccatcgtgcccgcgctggtgccggagtcgctgcaagagcaaatccagagcaacttcatcattgtcatacatccaggttcaacaactttaaggattggtcgagccacagacactcttcctgccagcattcctcacgtcattgcccgaagacacaaacaacaagggcagcccctatacaaggacagttggctcctaagggagggactaaataaaccagaaagtaatgaacaaagacaaaatggccttaaaatggtggatcaagcaatatggtctaaaaagatgtccaatggtacaagacgcattcctgtgtcccctgaacaggcacgctcctacaataagcagatgcgacctgcaattttagatcactgttcgggaaataagtggacaaacacatctcatcaccctgagtatttagtaggagaagaggccttgtatgttaatccactggactgttacaatattcactggcctatcagaagaggtcagttaaatattcacccaggccctgggggctctcttacagctgttctggcagatattgaagtaatatggtctcatgcgatacaaaaatacttggaaatcccactgaaagatttaaagtattatagatgtatcttgttaattcctgatatctataataagcagcatgtgaaagaactagtgaatatgatactaatgaagatgggtttttcagggattgtggtccatcaggagtctgtgtgtgccacctatggaagtggcttaagcagcacgtgtattgtagacgttggggaccagaagacaagtgtatgctgtgtggaggatggggtgtctcatcggaatactcggctttgtctggcatacggaggatctgatgtgtcaagatgtttttactggctaatgcagcgagctgggttcccttacagagaatgccagttaacaaataaaatggattgtcttcttctgcaacaccttaaagaaactttttgtcatttagatcaggacatctctgggcttcaggaccatgagtttcagattcgacatcctgattctcctgccctgctttaccagtttcgattaggagatgaaaaactgcaggctccaatggctttgttttaccccgcaacttttggaattgttggacagaaaatgacgactttgcagcacagatctcagggcgatcctgaggatcctcacgatgaacattacctgctggccacacagagcaaacaagaacagtctgcaaaagctactgctgaccgaaagtctgcatccaaacctattggatttgaaggggatcttcgtggccagtcctctgatcttccagaaagactccattcccaggaggtagatttggggtctgcacagggagatggcctgatggccggcaacgattccgaggaggccctcactgcactgatgtccaggaagactgccatctcgctgtttgaagggaaagccctgggcctggataaagccatcctccatagcatagactgctgttcatctgacgacaccaaaaagaagatgtacagctccatcctagtggtgggaggtggtttgatgtttcataaagctcaagaatttctgcagcacagaattctcaacaaaatgccaccatccttcaggcgaattattgaaaatgtggatgtgatcacaaggcctaaggacatggacccccggctgattgcatggaaaggaggggcagtgttggcttgtttggatacaacacaggaactgtggatttatcagcgagagtggcagcgctttggtgtccgcatgttacgagagcgggctgcgtttgtgtggtgaatggggaggaaatgtcactgccgaagaccaaaaacaagcttcttggtataaaagactcttacagaatatgtgtattgtaatttattgatctggatgcttaagtgtcatggacagtaaatgaatttgaactttatgttgaggacatgacattggtttgaaaatataaactgcttttgagcagtttagtcagggcatttgagaataaataggaactttctcttcagttgtaaactctcttgccctctctcagggtctcataaactccccagtgatgtaaacgttgctattgaaggttctcatgtggtgaagcccttcatttaagttggcttgaatctcatcagcaggcagcctcatgcaaccatgagggatagtatgtgacgagggagaactgtccactcatgccattttctctcttgtctagtatttcattaggatctaaagttgtctgagttaaatgcacttatgtgactcatgtgtcctcttagaatcccaaatagggggaaaaagttttggtggtttttgtttttttttcattttctgttggattacagaaaaagaatgggacccattcaggtctcgatttccaaaggtaaagatggaaggctgggcagactggcttttgttacctgacatgccgtagggtgagcttagaggaagaaagaaaacaatttttatttggccaaaacagaacaaatgctgaaaaggaaatcttgtttttttcctaaagccaaatagaaatgatttgggtataatttaagagtccttgtgttgtacagatatggtgactgatgtagttattaatactaccaacttagtcatcaagcctcaattttcctttacctgaaggattaagtgaaagcttttggagttcatgatgttcagtatgatcagttaaccttaacctctgagcatcctgaagcaaaatctaaataatgcagctattaccactggtggtccaggctctggtgaagccctctgagcccaggaggaagagaaagcattgtccagaggtaggaacacagtctgggagcccagagctctgggaggagtgggaaaatgctgcttcctgctgcttgcttctaggcacctgcttccgccatctcacttaccatggctagagatgggggtgagactggggaaggacaaaagcagggaacagataagggatggaaatcagaagggaatatagaaagaactctggatgtggagaaatgccggtacctgagcattttgtatcaatgggagtaccctctgtaactgctcagtaggttacaaatgaagagtccaccagtattagaaacaatttaaacttgccagtaccaactgggatgtgtgccttcaatttgaaaattgtatgttttattttttaaatttgttaacagcattaatttatagagtattgatgtcatttatgtttctgaggtgtttcaacacaattttggatcagctgcctgtttgcaaaaacataatatatttctgttaaacagttcttcacctaacagcatattgctcttataactggtagagctgtttcaaaggaagttggtttctggtccaagttttgacctaaaccatgtccatcttctattaccagcacttacaagcactgtgaaaactgatcatgacaaataagtaaaatttgctacatt

SEQ ID NO: 369265 - DNA, 3958 bp, Homo sapiens
ttccatcccggcagtcgtggctgcagcgctgaggcgagaggttggtgggtgtctccggccataatgacccaggctgagaagggtgatacggagaacggaaaggagaagggcggcgagaaggagaaggagcagcgcggcgtgaagcggcccatcgtgcccgcgctggtgccggagtcgctgcaagagcaaatccagagcaacttcatcattgtcatacatccaggttcaacaactttaaggattggtcgagccacagacactcttcctgccagcattcctcacgtcattgcccgaagacacaaacaacaagggcagcccctatacaaggacagttggctcctaagggagggactaaataaaccagaaagtaatgaacaaagacaaaatggccttaaaatggtggatcaagcaatatggtctaaaaagatgtccaatggtacaagacgcattcctgtgtcccctgaacaggcacgctcctacaataagcagatgcgacctgcaattttagatcactgttcgggaaataagtggacaaacacatctcatcaccctgagtatttagtaggagaagaggccttgtatgttaatccactggactgttacaatattcactggcctatcagaagaggtcagttaaatattcacccaggccctgggggctctcttacagctgttctggcagatattgaagtaatatggtctcatgcgatacaaaaatacttggaaatcccactgaaagatttaaagtattatagatgtatcttgttaattcctgatatctataataagcagcatgtgaaagaactagtgaatatgatactaatgaagatgggtttttcagggattgtggtccatcaggagtctgtgtgtgccacctatggaagtggcttaagcagcacgtgtattgtagacgttggggaccagaagacaagtgtatgctgtgtggaggatggggtgtctcatcggaatactcggctttgtctggcatacggaggatctgatgtgtcaagatgtttttactggctaatgcagcgagctgggttcccttacagagaatgccagttaacaaataaaatggattgtcttcttctgcaacaccttaaagaaactttttgtcatttagatcaggacatctctgggcttcaggaccatgagtttcagattcgacatcctgattctcctgccctgctttaccagtttcgattaggagatgaaaaactgcaggctccaatggctttgttttaccccgcaacttttggaattgttggacagaaaatgacgactttgcagcacagatctcagggcgatcctgaggatcctcacgatgaacattacctgctggccacacagagcaaacaagaacagtctgcaaaagctactgctgaccgaaagtctgcatccaaacctattggatttgaaggggatcttcgtggccagtcctctgatcttccagaaagactccattcccaggaggtagatttggggtctgcacagggagatggcctgatggccggcaacgattccgaggaggccctcactgcactgatgtccaggaagactgccatctcgctgtttgaagggaaagccctgggcctggataaagccatcctccatagcatagactgctgttcatctgacgacaccaaaaagaagatgtacagctccatcctagtggtgggaggtggtttgatgtttcataaagctcaagaatttctgcagcacagaattctcaacaaaatgccaccatccttcaggcgaattattgaaaatgtggatgtgatcacaaggcctaaggacatggacccccggctgattgcatggaaaggaggggcagtgttggcttgtttggatacaacacaggaactgtggatttatcagcgagagtggcagcgctttggtgtccgcatgttacgagagcgggctgcgtttgtgtggtgaatggggaggaaatgtcactgccgaagaccaaaaacaagcttcttggtataaaagactcttacagaatatgtgtattgtaatttattgatctggatgcttaagtgtcatggacagtaaatgaatttgaactttatgttgaggacatgacattggtttgaaaatataaactgcttttgagcagtttagtcagggcatttgagaataaataggaactttctcttcagttgtaaactctcttgccctctctcagggtctcataaactccccagtgatgtaaacgttgctattgaaggttctcatgtggtgaagcccttcatttaagttggcttgaatctcatcagcaggcagcctcatgcaaccatgagggatagtatgtgacgagggagaactgtccactcatgccattttctctcttgtctagtatttcattaggatctaaagttgtctgagttaaatgcacttatgtgactcatgtgtcctcttagaatcccaaatagggggaaaaagttttggtggtttttgtttttttttcattttctgttggattacagaaaaagaatgggacccattcaggtctcgatttccaaaggtaaagatggaaggctgggcagactggcttttgttacctgacatgccgtagggtgagcttagaggaagaaagaaaacaatttttatttggccaaaacagaacaaatgctgaaaaggaaatcttgtttttttcctaaagccaaatagaaatgatttgggtataatttaagagtccttgtgttgtacagatatggtgactgatgtagttattaatactaccaacttagtcatcaagcctcaattttcctttacctgaaggattaagtgaaagcttttggagttcatgatgttcagtatgatcagttaaccttaacctctgagcatcctgaagcaaaatctaaataatgcagctattaccactggtggtccaggctctggtgaagccctctgagcccaggaggaagagaaagcattgtccagaggtaggaacacagtctgggagcccagagctctgggaggagtgggaaaatgctgcttcctgctgcttgcttctaggcacctgcttccgccatctcacttaccatggctagagatgggggtgagactggggaaggacaaaagcagggaacagataagggatggaaatcagaagggaatatagaaagaactctggatgtggagaaatgccggtacctgagcattttgtatcaatgggagtaccctctgtaactgctcagtaggttacaaatgaagagtccaccagtattagaaacaatttaaacttgccagtaccaactgggatgtgtgccttcaatttgaaaattgtatgttttattttttaaatttgttaacagcattaatttatagagtattgatgtcatttatgtttctgaggtgtttcaacacaattttggatcagctgcctgtttgcaaaaacataatatatttctgttaaacagttcttcacctaacagcatattgctcttataactggtagagctgtttcaaaggaagttggtttctggtccaagttttgacctaaaccatgtccatcttctattaccagcacttacaagcactgtgaaaactgatcatgacaaataagtaaaatttgctacattaaacatattgcctcagccattactaagcgtccacttgtaaagctggacacagtttttactttatgcttcattttgattttttatccgtaagacataaattagaaggcatgaggtggccctttaaggataatctgcaaatatacacattttaatagtcatccatctgaaatcgatccacattccagagaagattcagtattgtgctgtgtgaaataagcattcccagaaaaaaaacatttatgctaataatacaacataacctctgcattaaagaaaaagatgcttttaggccaggcgccgtggctcacacctgtaatcccatctcagcctccctagtagctgggaccacaggcttacaccatcacactcag

SEQ ID NO: 369266 - DNA, 1716 bp, Homo sapiens
ttccatcccggcagtcgtggctgcagcgctgaggcgagaggttggtgggtgtctccggccataatgacccaggctgagaagggtgatacggagaacggaaaggagaagggcggcgagaaggagaaggagcagcgcggcgtgaagcggcccatcgtgcccgcgctggtgccggagtcgctgcaagagcaaatccagagcaacttcatcattgtcatacatccaggttcaacaactttaaggattggtcgagccacagacactcttcctgccagcattcctcacgtcattgcccgaagacacaaacaacaagggcagcccctatacaaggacagttggctcctaagggagggactaaataaaccagaaagtaatgaacaaagacaaaatggccttaaaatggtggatcaagcaatatggtctaaaaagatgtccaatggtacaagacgcattcctgtgtcccctgaacaggcacgctcctacaataagcagatgcgacctgcaattttagatcactgttcgggaaataagtggacaaacacatctcatcaccctgagtatttagtaggagaagaggccttgtatgttaatccactggactgttacaatattcactggcctatcagaagaggtcagttaaatattcacccaggccctgggggctctcttacagctgttctggcagatattgaagtaatatggtctcatgcgatacaaaaatacttggaaatcccactgaaagatttaaagtattatagatgtatcttgttaattcctgatatctataataagcagcatgtgaaagaactagtgaatatgatactaatgaagatgggtttttcagggattgtggtccatcaggagtctgtgtgtgccacctatggaagtggcttaagcagcacgtgtattgtagacgttggggaccagaagacaagtgtatgctgtgtggaggatggggtgtctcatcggaatactcggctttgtctggcatacggaggatctgatgtgtcaagatgtttttactggctaatgcagcgagctgggttcccttacagagaatgccagttaacaaataaaatggattgtcttcttctgcaacaccttaaagaaactttttgtcatttagatcaggacatctctgggcttcaggaccatgagtttcagattcgacatcctgattctcctgccctgctttaccagtttcgattaggagatgaaaaactgcaggctccaatggctttgttttaccccgcaacttttggaattgttggacagaaaatgacgactttgcagcacagatctcagggcgatcctgaggatcctcacgatgaacattacctgctggccacacagagcaaacaagaacagtctgcaaaagctactgctgaccgaaagtctgcatccaaacctattggatttgaaggggatcttcgtggccagtcctctgatcttccagaaagactccattcccaggaggtagatttggggtctgcacagggagatggcctgatggccggcaacgattccgaggaggccctcactgcactgatgtccaggaagactgccatctcgctgtttgaagggaaagccctgggcctggataaagccatcctccatagcatagactgctgttgtaagcacatctggggagaccgggagatagcagtgaaacaagatagcagttaaataaattggttcagtctaggatatacttgtgca

SEQ ID NO: 369267 - DNA, 810 bp, Homo sapiens
aatttatagagtattgatgtcatttatgtttctgaggtgtttcaacacaattttggatcagctgcctgtttgcaaaaacataatatatttctgttaaacagttcttcacctaacagcatattgctcttataactggtagagctgtttcaaaggaagttggtttctggtccaagttttgacctaaaccatgtccatcttctattaccagcacttacaagcactgtgaaaactgatcatgacaaataagtaaaatttgctacattaaacatattgcctcagccattactaagcgtccacttgtaaagctggacacagtttttactttatgcttcattttgattttttatccgtaagacataaattagaaggcatgaggtggccctttaaggataatctgcaaatatacacattttaatagtcatccatctgaaatcgatccacattccagagaagattcagtattgtgctgtgtgaaataagcattcccagaaaaaaaacatttatgctaataatacaacataacctctgcattaaagaaaaagatgcttttaggccaggcgccgtggctcacacctgtaatccctgcactttgagaggctgaggtgggtggatcatgaggtcaggagatcaagaccatcctggctaacagggtgaaaccccgtctctactaaaaatataaaaagttagctgggtgtggtggtgggtgcctgtagtcccagctactcaggaggctgaggcaggagaatggcgtgaacccggaaggcagaggttgtagtgagccgaggtcacgccactgcactccagcctggg

SEQ ID NO: 369268 - DNA, 3491 bp, Homo sapiens
cgctccgatctcccgcacgccccaccgtctggttgtgtgcgctcctgcccgggctctggcctcagcttccccgaccataaaacgaccacgcaaatccagagcaacttcatcattgtcatacatccaggttcaacaactttaaggattggtcgagccacagacactcttcctgccagcattcctcacgtcattgcccgaagacacaaacaacaagggcagcccctatacaaggacagttggctcctaagggagggactaaataaaccagaaagtaatgaacaaagacaaaatggccttaaaatggtggatcaagcaatatggtctaaaaagatgtccaatggtacaagacgcattcctgtgtcccctgaacaggcacgctcctacaataagcagatgcgacctgcaattttagatcactgttcgggaaataagtggacaaacacatctcatcaccctgagtatttagtaggagaagaggccttgtatgttaatccactggactgttacaatattcactggcctatcagaagaggtcagttaaatattcacccaggccctgggggctctcttacagctgttctggcagatattgaagtaatatggtctcatgcgatacaaaaatacttggaaatcccactgaaagatttaaagtattatagatgtatcttgttaattcctgatatctataataagcagcatgtgaaagaactagtgaatatgatactaatgaagatgggtttttcagggattgtggtccatcaggagtctgtgtgtgccacctatggaagtggcttaagcagcacgtgtattgtagacgttggggaccagaagacaagtgtatgctgtgtggaggatggggtgtctcatcggaatactcggctttgtctggcatacggaggatctgatgtgtcaagatgtttttactggctaatgcagcgagctgggttcccttacagagaatgccagttaacaaataaaatggattgtcttcttctgcaacaccttaaagaaactttttgtcatttagatcaggacatctctgggcttcaggaccatgagtttcagattcgacatcctgattctcctgccctgctttaccagtttcgattaggagatgaaaaactgcaggctccaatggctttgttttaccccgcaacttttggaattgttggacagaaaatgacgactttgcagcacagatctcagggcgatcctgaggatcctcacgatgaacattacctgctggccacacagagcaaacaagaacagtctgcaaaagctactgctgaccgaaagtctgcatccaaacctattggatttgaaggggatcttcgtggccagtcctctgatcttccagaaagactccattcccaggaggtagatttggggtctgcacagggagatggcctgatggccggcaacgattccgaggaggccctcactgcactgatgtccaggaagactgccatctcgctgtttgaagggaaagccctgggcctggataaagccatcctccatagcatagactgctgttcatctgacgacaccaaaaagaagatgtacagctccatcctagtggtgggaggtggtttgatgtttcataaagctcaagaatttctgcagcacagaattctcaacaaaatgccaccatccttcaggcgaattattgaaaatgtggatgtgatcacaaggcctaaggacatggacccccggctgattgcatggaaaggaggggcagtgttggcttgtttggatacaacacaggaactgtggatttatcagcgagagtggcagcgctttggtgtccgcatgttacgagagcgggctgcgtttgtgtggtgaatggggaggaaatgtcactgccgaagaccaaaaacaagcttcttggtataaaagactcttacagaatatgtgtattgtaatttattgatctggatgcttaagtgtcatggacagtaaatgaatttgaactttatgttgaggacatgacattggtttgaaaatataaactgcttttgagcagtttagtcagggcatttgagaataaataggaactttctcttcagttgtaaactctcttgccctctctcagggtctcataaactccccagtgatgtaaacgttgctattgaaggttctcatgtggtgaagcccttcatttaagttggcttgaatctcatcagcaggcagcctcatgcaaccatgagggatagtatgtgacgagggagaactgtccactcatgccattttctctcttgtctagtatttcattaggatctaaagttgtctgagttaaatgcacttatgtgactcatgtgtcctcttagaatcccaaatagggggaaaaagttttggtggtttttgtttttttttcattttctgttggattacagaaaaagaatgggacccattcaggtctcgatttccaaaggtaaagatggaaggctgggcagactggcttttgttacctgacatgccgtagggtgagcttagaggaagaaagaaaacaatttttatttggccaaaacagaacaaatgctgaaaaggaaatcttgtttttttcctaaagccaaatagaaatgatttgggtataatttaagagtccttgtgttgtacagatatggtgactgatgtagttattaatactaccaacttagtcatcaagcctcaattttcctttacctgaaggattaagtgaaagcttttggagttcatgatgttcagtatgatcagttaaccttaacctctgagcatcctgaagcaaaatctaaataatgcagctattaccactggtggtccaggctctggtgaagccctctgagcccaggaggaagagaaagcattgtccagaggtaggaacacagtctgggagcccagagctctgggaggagtgggaaaatgctgcttcctgctgcttgcttctaggcacctgcttccgccatctcacttaccatggctagagatgggggtgagactggggaaggacaaaagcagggaacagataagggatggaaatcagaagggaatatagaaagaactctggatgtggagaaatgccggtacctgagcattttgtatcaatgggagtaccctctgtaactgctcagtaggttacaaatgaagagtccaccagtattagaaacaatttaaacttgccagtaccaactgggatgtgtgccttcaatttgaaaattgtatgttttattttttaaatttgttaacagcattaatttatagagtattgatgtcatttatgtttctgaggtgtttcaacacaattttggatcagctgcctgtttgcaaaaacataatatatttctgttaaacagttcttcacctaacagcatattgctcttataactggtagagctgtttcaaaggaagttggtttctggtccaagttttgacctaaaccatgtccatcttctattaccagcacttacaagcactgtgaaaactgatcatgacaaataagtaaaatttgctacatt

SEQ ID NO: 369269 - DNA, 3985 bp, Homo sapiens
ttccatcccggcagtcgtggctgcagcgctgaggcgagaggttggtgggtgtctccggccataatgacccaggctgagaagggtgatacggagaacggaaaggagaagggcggcgagaaggagaaggagcagcgcggcgtgaagcggcccatcgtgcccgcgctggtgccggagtcgctgcaagagcaaatccagagcaacttcatcattgtcatacatccaggttcaacaactttaaggattggtcgagccacagacactcttcctgccagcattcctcacgtcattgcccgaagacacaaacaacaagggcagcccctatacaaggacagttggctcctaagggagggactaaataaaccagaaagtaatgaacaaagacaaaatggccttaaaatggtggatcaagcaatatggtctaaaaagatgtccaatggtacaagacgcattcctgtgtcccctgaacaggcacgctcctacaataagcagatgcgacctgcaattttagatcactgttcgggaaataagtggacaaacacatctcatcaccctgagtatttagtaggagaagaggccttgtatgttaatccactggactgttacaatattcactggcctatcagaagaggtcagttaaatattcacccaggccctgggggctctcttacagctgttctggcagatattgaagtaatatggtctcatgcgatacaaaaatacttggaaatcccactgaaagatttaaagtattatagatgtatcttgttaattcctgatatctataataagcagcatgtgaaagaactagtgaatatgatactaatgaagatgggtttttcagggattgtggtccatcaggagtctgtgtgtgccacctatggaagtggcttaagcagcacgtgtattgtagacgttggggaccagaagacaagtgtatgctgtgtggaggatggggtgtctcatcggaatactcggctttgtctggcatacggaggatctgatgtgtcaagatgtttttactggctaatgcagcgagctgggttcccttacagagaatgccagttaacaaataaaatggattgtcttcttctgcaacaccttaaagaaactttttgtcatttagatcaggacatctctgggcttcaggaccatgagtttcagattcgacatcctgattctcctgccctgctttaccagtttcgattaggagatgaaaaactgcaggctccaatggctttgttttaccccgcaacttttggaattgttggacagaaaatgacgactttgcagcacagatctcagggcgatcctgaggatcctcacgatgaacattacctgctggccacacagagcaaacaagaacagtctgcaaaagctactgctgaccgaaagtctgcatccaaacctattggatttgaaggggatcttcgtggccagtcctctgatcttccagaaagactccattcccaggaggtagatttggggtctgcacagggagatggcctgatggccggcaacgattccgaggaggccctcactgcactgatgtccaggaagactgccatctcgctgtttgaagggaaagccctgggcctggataaagccatcctccatagcatagactgctgttcatctgacgacaccaaaaagaagatgtacagctccatcctagtggtgggaggtggtttgatgtttcataaagctcaagaatttctgcagcacagaattctcaacaaaatgccaccatccttcaggcgaattattgaaaatgtggatgtgatcacaaggcctaaggctgaaatgccttcatcccttctgtaggacatggacccccggctgattgcatggaaaggaggggcagtgttggcttgtttggatacaacacaggaactgtggatttatcagcgagagtggcagcgctttggtgtccgcatgttacgagagcgggctgcgtttgtgtggtgaatggggaggaaatgtcactgccgaagaccaaaaacaagcttcttggtataaaagactcttacagaatatgtgtattgtaatttattgatctggatgcttaagtgtcatggacagtaaatgaatttgaactttatgttgaggacatgacattggtttgaaaatataaactgcttttgagcagtttagtcagggcatttgagaataaataggaactttctcttcagttgtaaactctcttgccctctctcagggtctcataaactccccagtgatgtaaacgttgctattgaaggttctcatgtggtgaagcccttcatttaagttggcttgaatctcatcagcaggcagcctcatgcaaccatgagggatagtatgtgacgagggagaactgtccactcatgccattttctctcttgtctagtatttcattaggatctaaagttgtctgagttaaatgcacttatgtgactcatgtgtcctcttagaatcccaaatagggggaaaaagttttggtggtttttgtttttttttcattttctgttggattacagaaaaagaatgggacccattcaggtctcgatttccaaaggtaaagatggaaggctgggcagactggcttttgttacctgacatgccgtagggtgagcttagaggaagaaagaaaacaatttttatttggccaaaacagaacaaatgctgaaaaggaaatcttgtttttttcctaaagccaaatagaaatgatttgggtataatttaagagtccttgtgttgtacagatatggtgactgatgtagttattaatactaccaacttagtcatcaagcctcaattttcctttacctgaaggattaagtgaaagcttttggagttcatgatgttcagtatgatcagttaaccttaacctctgagcatcctgaagcaaaatctaaataatgcagctattaccactggtggtccaggctctggtgaagccctctgagcccaggaggaagagaaagcattgtccagaggtaggaacacagtctgggagcccagagctctgggaggagtgggaaaatgctgcttcctgctgcttgcttctaggcacctgcttccgccatctcacttaccatggctagagatgggggtgagactggggaaggacaaaagcagggaacagataagggatggaaatcagaagggaatatagaaagaactctggatgtggagaaatgccggtacctgagcattttgtatcaatgggagtaccctctgtaactgctcagtaggttacaaatgaagagtccaccagtattagaaacaatttaaacttgccagtaccaactgggatgtgtgccttcaatttgaaaattgtatgttttattttttaaatttgttaacagcattaatttatagagtattgatgtcatttatgtttctgaggtgtttcaacacaattttggatcagctgcctgtttgcaaaaacataatatatttctgttaaacagttcttcacctaacagcatattgctcttataactggtagagctgtttcaaaggaagttggtttctggtccaagttttgacctaaaccatgtccatcttctattaccagcacttacaagcactgtgaaaactgatcatgacaaataagtaaaatttgctacattaaacatattgcctcagccattactaagcgtccacttgtaaagctggacacagtttttactttatgcttcattttgattttttatccgtaagacataaattagaaggcatgaggtggccctttaaggataatctgcaaatatacacattttaatagtcatccatctgaaatcgatccacattccagagaagattcagtattgtgctgtgtgaaataagcattcccagaaaaaaaacatttatgctaataatacaacataacctctgcattaaagaaaaagatgcttttaggccaggcgccgtggctcacacctgtaatcccatctcagcctccctagtagctgggaccacaggcttacaccatcacactcag

SEQ ID NO: 369270 - DNA, 1990 bp, Homo sapiens
aaatggtaacccagtagcccaaaagacaaagtccttctcaacaaagcctaaccaacaggcaatggattatagtgattcagaggaaagataagaaggttcctttgtcttggacctccactagacatcaaggaaacatgccaaaaaagtaaacaacaaaggcccccacacctttccaaactacaacccaaaataagttgatctgagaaacaaattgcaatgccgcatgcaaagcagatgtgtccaaattcatgtaggaccagacacatcctgaacctttcagtgcaacagctgttcaagactttcttcaaaatcatccaagcacaagggttgataaaatacacacaaaatggctgatgctcaaaccaaccaaaacaccaggctctttgctgaaacctctgagaagggttcctggctccaggtcagcctcaatggaataaaggaagatcacctaccacttcaaactgaagagctgaaggagttgtatcaagatacagagtgcagcaagtataggaaacattagagaaactgacctgtctggagatggcaagctgcagagccagcatctaaaatggcagctgaagcttgtcggctttgcggagggcctcgaggtgaagaatccataggccctgaggtctgatctccccagcagatgggtctctgtgtcgtgctgggacgcagtgaagccatgtgtgcacttggcaaggcgatggctgctttgacagggtcttactctatcacccaggctggagtgcagtggcatgatcactgctcattgcagcctcaacctcccagggcccaagcgatcctcccatcttagcctcccaaggtgctgggaccacaggcgtgctccccacgcccagctaatttatagaattttttgtagacccggggtttcaacatgctatccaggctagtctggaactactaggctcaagtgatcctcccactttggcatcccaaaaccctgggattacaggcataagccaccacgcccagctactaaatggcttatttctaaggtccactcagtatatagcagcttttataattttacaaatattggctttccatgaatttgtacatcaaagaatatttttctttggtgtttataaaagtgagattgaaaaatcatggtttctctcataattattcaggaaaaataatacacaattatgaagaaatttttagatttattttatcttctttcacaaataataaatttacagaaccctcaaaaagaacttcttagagttataattttctcagttcaattcatattcttcacaaataaatcaagtcatggttgcctctatgcaataccaaccaactgaaaagctggcaatgatctgttgagttgagggtgtacataaagatagttctggctaaaggccccatgctggcctcatcaaatgatttttctctgttaaccacagcaccgtgaaaggaacaaaccagaagtgctagaaatcttggtatttctggagtgcattagggcaacatctgaaggatttccaacttggctaatgatgcatattcaactgccaaatttctaatgaggcacaactgaaacatatacattttaaaaaccttatttctacaacttggctaatgaattcaactgaccacttcaccctctgaaggaaataaggcaaatgccaaacaaaacaagaaaaagctccctgtgttgatctcaagtagatgctaaaatacttgcttcccgtggagcaacttcagcagctaagcttcctgtgggaaagcccctttggtatgccacaggcaactcgccggacagaaatcctcaggccaggcagatgagagagaggacattagtgatcagaaaaattgcaagccttctgaactctgtaaatgaatctaaagcagcctcataaactccgtgcccataaactgaacacctggctagactgctcagaaatacctaaaagacctaaaaatgtcaccacaaggatgctcacaaaatgcttcccttatc

SEQ ID NO: 369271 - DNA, 641 bp, Homo sapiens
aaatggtaacccagtagcccaaaagacaaagtccttctcaacaaagcctaaccaacaggcaatggattatagtgattcagaggaaagataagaaggttcctttgtcttggacctccactagacatcaaggaaacatgccaaaaaagtaaacaacaaaggcccccacacctttccaaactacaacccaaaataagttgatctgagaaacaaattgcaatgccgcatgcaaagcagatgtgtccaaattcatgtaggaccagacacatcctgaacctttcagtgcaacagctgttcaagactttcttcaaaatcatccaagcacaagggttgataaaatacacacaaaatgggtatgtgacaccctggattccatgcaggtttggcagtaaccagggagaattagaacccgaagctagatttcgaaatagagctctggactgaagcattcttgcacaaccatcccacagatggcttccggtctcgctccaactccagtcctctgtggggcctcttctcagctctcctgctttttcccaaaccctcagtaacctccctccttagtagaaggctatgacttctctttcccaaaccaattacttttcctcaatgaacttcttttcttgatggatttaggttataac

SEQ ID NO: 369272 - DNA, 429 bp, Homo sapiens
tttttctttttctttttcagacagggtcttactctatcacccaggctggagtgcagtggcatgatcactgctcattgcagcctcaacctcccagggcccaagcgatcctcccatcttagcctcccaaggtgctgggaccacaggcgtgctccccacgcccagctaatttatagaattttttgtagacccggggtttcaacatgctatccaggctagtctggaactactaggctcaagtgatcctcccactttggcatcccaaaaccctgggattacaggcataagccaccacgcccagctactaaatggcttatttctaaggtccactcagtatatagcagcttttataattttacaaatattggctttccatgaatttgtacatcaaagaatatttttctttggtgtttataaaagtgagattgaaaa

SEQ ID NO: 369273 - DNA, 1102 bp, Homo sapiens
acgacgcgccggaaagcaacggcaagggccgcagccagcaccgggcggagagggctaccatggggaaaatcgcgctgcaactcaaagccacgctggagaacatcaccaacctccggcccgtgggcgaggacttccggtggtacctgaagatgaaatgtggcaactgtggtgagatttcggacaagtggcagtacatccggctgatggacagtgtggcactgaaggggggccgtggcagtgcttccatggtccagaagtgcaagctgtgtgcaagagaaaattccatcgagattttaagcagcaccatcaagccttacaatgctgaagacaatgagaacttcaagacaatagtggagtttgagtgccggggccttgaaccagttgatttccagccgcaggctgggtttgctgctgaaggtgtggagtcagggacagccttcagtgacattaatctgcaggagaaggactggactgactatgatgaaaaggcccaggagtctgtgggaatctatgaggtcacccaccagtttgtgaagtgctgatccctcttccttcccagttgcccttaagaactgagaaaggacaaagtactctaagcagcagagcccacagaggctcgttcctttgacccttgtctcctggtggctatacgaaaccttcacaatctgcatgctggactttattacagcttcccaagccccatcaataaagcccctgttcacgctgcactggtgcatgaaggtgaagtaaggaggcagctactccctccacaaataagaattcgtgcagcagcagttcactccttaggaaaatgaagagtatttttaaggagatggtatctccccagtcaagggcaagtttacagagatgaaaccgcgatcccaccatcactcaatgagccagaagccaatggtgacgtactgttacctgaacttactgaacttgctgttggaaagatctttgtgaggattaggaattaggttaaaagaaattaagaaccatcttcaagcaaaaattaaactttatttctgcttaaacaataaatacacctgagttagttttccaaacctttcctcctgattaaatgcccttaaaacttaaa

SEQ ID NO: 369274 - DNA, 731 bp, Homo sapiens
acgacgcgccggaaagcaacggcaagggccgcagccagcaccgggcggagagggctaccatgggggtgaggggaggccgcccgccgcggggacacggaggggaggtggcgagggtctgggaggcaacagctcgcgccaggaggagatgaagcgagtgggtgcgcgctgaaggagcaggaggcagaaggagtgtctccctgtggcacccacggctgggaatgcgggagggtcgggcaggcgtggggctgcgcaggcacggctgacgcagtcgctctggccctccccctcagaaaatcgcgctgcaactcaaagccacgctggagaacatcaccaacctccggcccgtgggcgaggacttccggtggtacctgaagatgaaatgtggcaactgtggtgagatttcggacaagtggcagtacatccggctgatggacagtgtggcactgaaggggggccgtggcagtgcttccatggtccagaagtgcaagctgtgtgcaagagaaaattccatcgagattttaagcagcaccatcaagccttacaatgctgaagacaatgagaacttcaagacaatagtggagtttgagtgccggggccttgaaccagttgatttccagccgcaggctgggtttgctgctgaaggtgtggagtcagggacagccttcagtgacattaatctgcaggagaagcacgcaaggggaccttggggaaccttggaaacctttaatttg

SEQ ID NO: 369275 - DNA, 1895 bp, Homo sapiens
acgacgcgccggaaagcaacggcaagggccgcagccagcaccgggcggagagggctaccatggggaaaatcgcgctgcaactcaaagccacgctggagaacatcaccaacctccggcccgtgggcgaggacttccggtggtacctgaagatgaaatgtggcaactgtggtgagatttcggacaagtggcagtacatccggctgatggacagtgtggcactgaaggggggccgtggcagtgcttccatggtccagaagtgcaagctgtgtgcaagagaaaattccatcgagattttaagcagcaccatcaagccttacaatgctgaagacaatgagaacttcaagacaatagtggagtttgagtgccggggccttgaaccagttgatttccagccgcaggctgggtttgctgctgaaggtgtggagtcagggacagccttcagtgacattaatctgcaggagaaggactggactgactatgatgaaaaggcccaggagtctgtgggaatctatgaggtcacccaccagtttgtgaagtgctgatccctcttccttcccagttgcccttaagaactgagaaaggacaaagtactctaagcagcagagcccacagaggctcgttcctttgacccttgtctcctggtggctatacgaaaccttcacaatctgcatgctggactttattacagcttcccaagccccatcaataaagcccctgttcacgctgcactggtgcatgaaggtgaagtaaggaggcagctactccctccacaaataagaattcgtgcagcagcagttcactccttaggaaaatgaagagtatttttaaggagatggtatctccccagtcaagggcaagtttacagagatgaaaccgcgatcccaccatcactcaatgagccagaagccaatggtgacgtactgttacctgaacttactgaacttgctgttggaaagatctttgtgaggattaggaattaggttaaaagaaattaagaaccatcttcaagcaaaaattaaactttatttctgcttaaacaataaatacacctgagttagttttccaaacctttcctcctgattaaatgcccttaaaacttaaatctcttgttatcttcagttgtgatctagtcccaagtggaaattacgtttagctttaaaaccatgaatttaaagctcaagcctgtagctggctgcctaggcagcttatgattagtttcacagaatagcacccactggctacacaggccccagtttttttttcttttttgtttttttgagacagtctcgctctgtcgcccaggccggagtgcagtggtgtgatctcagctcactgcaacctccactcctggggttcaagcaattctgcttctgtatttttagtagagacaaggtttcaccatgttggccaggttggtctcaaactcctgacctcaagtgatccacccgcctcagcctctcaaaatgctgggattacaggcatgagccaccatgcccggcctcccagttttcatgatgaggaagtgatggtagcttttcatctgcccagaagttaacttttgatggatttgccttctaaggcatcaaacatgtcttctaaggccttctccacacattggagaaactcccgggcattgcggcctgggtaggaagagacattgcagcctatccagttgtcatgaacagcatacccaacaccaaagccatcagagaccacaggggcaaagcccccaaggttcactgctgggctgctcagtgtgctcgtggacaggacattgtggtttatctgcccgtatgcagggtccaggtatgccaggggaaactcgggggcggggctgctgtctgagagaatgtacttcagatgtgcctggatttccgaggggctcacaatgttcc

SEQ ID NO: 369276 - DNA, 1743 bp, Homo sapiens
acgacgcgccggaaagcaacggcaagggccgcagccagcaccgggcggagagggctaccatggggaaaatcgcgctgcaactcaaagccacgctggagaacatcaccaacctccggcccgtgggcgaggacttccggtggtacctgaagatgaaatgtggcaactgtggtgagatttcggacaagtggcagtacatccggctgatggacagtgtggcactgaaggggggccgtggcagtgcttccatggtccagaagtgcaagctgtgtgcaagagaaaattccatcgagattttaagcagcaccatcaagccttacaatgctgaagacaatgagaacttcaagacaatagtggagtttgagtgccggggccttgaaccagttgatttccagccgcaggctgggtttgctgctgaaggtgtggagtcagggacagccttcagtgacattaatctgcaggagaaggactggactgactatgatgaaaaggcccaggagtctgtgggaatctatgaggtcacccaccagtttgtgaagtgctgatccctcttccttcccagttgcccttaagaactgagaaaggacaaagtactctaagcagcagagcccacagaggctcgttcctttgacccttgtctcctggtggctatacgaaaccttcacaatctgcatgctggactttattacagcttcccaagccccatcaataaagcccctgttcacgctgcactggtgcatgaaggtgaagtaaggaggcagctactccctccacaaataagaattcgtgcagcagcagttcactccttaggaaaatgaagagtatttttaaggagatggtatctccccagtcaagggcaagtttacagagatgaaaccgcgatcccaccatcactcaatgagccagaagccaatggtgacgtactgttacctgaacttactgaacttgctgttggaaagatctttgtgaggattaggaattaggttaaaagaaattaagaaccatcttcaagcaaaaattaaactttatttctgcttaaacaataaatacacctgagttagttttccaaacctttcctcctgattaaatgcccttaaaacttaaatctcttgttatcttcagttgtgatctagtcccaagtggaaattacgtttagctttaaaaccatgaatttaaagctcaagcctgtagctggctgcctaggcagcttatgattagtttcacagaatagcacccactggctacacaggccccagtttttttttcttttttgtttttttgagacagtctcgctctgtcgcccaggccggagtgcagtggtgtgatctcagctcactgcaacctccactcctggggttcaagcaattctgcttcaacctcccaagtagctgggattataggcacatgccaccacacccagctaatttttgtatttttagtagagacaaggtttcaccatgttggccaggttggtctcaaactcctgacctcaagtgatccacccgcctcagcctctcaaaatgctgggattacaggcatgagccaccatgcccggcctcccagttttcatgatgaggaagtgatggtagcttttcatctgcccagaagttaacttttgatggatttgccttctaaggcatcaaacatgtcttctaaggccttctccaatgtgtggagaaggccttagaagacatgtttgatgcctcagaagtacacttttgatggatttgccttctaaggtcgagc

SEQ ID NO: 369277 - DNA, 2437 bp, Homo sapiens
acgacgcgccggaaagcaacggcaagggccgcagccagcaccgggcggagagggctaccatggggaaaatcgcgctgcaactcaaagccacgctggagaacatcaccaacctccggcccgtgggcgaggacttccggtggtacctgaaggtgcggccggggcggggcccggggagaggaggcccgtcctgatctcagtgctgaaccggagccttctctccggcagtatgagaaaatatttaaccaggcacattaagtgttcggggttttcctagttagaattttacgtttgctttctattaaagtgtattggtttatctctaattggcagtcttggaaagcttcattttgtagttcttccctgtgttaaatatttcgtggtctgtaaatggacactaaacgaaatgctacttgaagggacgcttgtgattatttaataaggtgaatagttcgcctttcgtttattgatttggttttctttattgtgaaatagtttaattttgtgcgtaatccacccttccttagccctcccacactggtaaagctggtaccctagtggcatggtctacagaggcctccccttccccagcagttcgaggctcttcactcttccagatcccagagcttctgctctgttttactcctggtcaaaaatcccagcatccttctgtacctctcaaaagccctgttttcgggaagctgcctccggactacttttgtttcccaggattttgaagcctgaataccagggcttacttgggagaatctgttctttggcttgaagaagcggaatcgagtgaaggagacagaaaaatagagtaacaatagagtgataagtgcttataccagtgacatacagggcctgtgggaacataaagctaaccaagcagagtgggtcgggggcctgctgaggccatttctctttttttttcttaattgacacagaattgtacatatttatggggtatatagtgatgttccgataaatgtaatgtattgtgatcagatcaaggtagttagcatattcacctcaaacgtgtatcatttctttgtgttgggagcatttaatatcctagctatttgaaactatatattattgtcagctatagtcatcctacagtgctatagaacactagaacttattcctcccatatagctgtaattttgtatcttctaacaaatctctccatattcccccccctcacctccgctgaaaccatttctgcaccacaggtgccttgaatccccggccacactgagcacttcatagaggagggtgggcacgccggcataggaaacagccttacctatcctttgcccagagatagttctagttttgtccttgttggggcaggtgttagggatgaagtgagattgccatcaagaaggtagatcatgagcctgcccacctcccactgttcttaccctttccttggtgtctgtgcagcagagccagctgctttactaacattcttttccccaaagatgaaatgtggcaactgtggtgagatttcggacaagtggcagtacatccggctgatggacagtgtggcactgaaggggggccgtggcagtgcttccatggtccagaagtgcaagctgtgtgcaagagaaaattccatcgagattttaagcagcaccatcaagccttacaatgctgaagacaatgagaacttcaagacaatagtggagtttgagtgccggggccttgaaccagttgatttccagccgcaggctgggtttgctgctgaaggtgtggagtcagggacagccttcagtgacattaatctgcaggagaaggactggactgactatgatgaaaaggcccaggagtctgtgggaatctatgaggtcacccaccagtttgtgaagtgctgatccctcttccttcccagttgcccttaagaactgagaaaggacaaagtactctaagcagcagagcccacagaggctcgttcctttgacccttgtctcctggtggctatacgaaaccttcacaatctgcatgctggactttattacagcttcccaagccccatcaataaagcccctgttcacgctgcactggtgcatgaaggtgaagtaaggaggcagctactccctccacaaataagaattcgtgcagcagcagttcactccttaggaaaatgaagagtatttttaaggagatggtatctccccagtcaagggcaagtttacagagatgaaaccgcgatcccaccatcactcaatgagccagaagccaatggtgacgtactgttacctgaacttactgaacttgctgttggaaagatctttgtgaggattaggaattaggttaaaagaaattaagaaccatcttcaagcaaaaattaaactttatttctgcttaaacaataaatacacctgagttagttttccaaacctttcctcctgattaaatgcccttaaaacttaaa

SEQ ID NO: 369278 - DNA, 1042 bp, Homo sapiens
acgacgcgccggaaagcaacggcaagggccgcagccagcaccgggcggagagggctaccatggggaaaatcgcgctgcaactcaaagccacgctggagaacatcaccaacctccggcccgtgggcgaggacttccggtggtacctgaagatgaaatgtggcaactgtggtgagatttcggacaagtggcagtacatccggctgatggacagtgtggcactgaaggggggccgtggcagtgcttccatggtccagaagtgcaagctgtgtgcaagagaaaattccatcgagattttaagcagcaccatcaagccttacaatgctgaagacaatgagaacttcaagacaatagtggagtttgagtgccggggccttgaaccagttgatttccagccgcaggctgggtttgctgctgaaggtgtggagtcagggacagccttcagtgacattaatctgcaggagaaggactggactgactatgatgaaaaggcccaggagtctgtgggaatctatgaggtcacccaccagtttgtgaagtgctgatccctcttccttcccagttgcccttaagaactgagaaaggacaaagtactctaagcagcagagcccacagaggctcgttcctttgacccttgtctcctggtggctatacgaaaccttcacaatctgcatgctggactttattacagcttcccaagccccatcaataaagcccctgttcacgctgcactggtgcatgaaggtgaagtaaggaggcagctactccctccacaaataagaattcgtgcagcagcagttcactccttaggaaaatgaagagtatttttaaggagatggtatctccccagtcaagggcaagtttacagagatgaaaccgcgatcccaccatcactcaatgagccagaagccaatggtgacgtactgttacctgaacttactgaacttgctgttggaaagatctttgtgaggattaggaattaggttaaaagaaattaagaaccatcttcaagcaaaaattaaactttatttctgcttaaacaata

SEQ ID NO: 369279 - DNA, 961 bp, Homo sapiens
acgacgcgccggaaagcaacggcaagggccgcagccagcaccgggcggagagggctaccatgggggacagtgtggcactgaaggggggccgtggcagtgcttccatggtccagaagtgcaagctgtgtgcaagagaaaattccatcgagattttaagcagcaccatcaagccttacaatgctgaagacaatgagaacttcaagacaatagtggagtttgagtgccggggccttgaaccagttgatttccagccgcaggctgggtttgctgctgaaggtgtggagtcagggacagccttcagtgacattaatctgcaggagaaggactggactgactatgatgaaaaggcccaggagtctgtgggaatctatgaggtcacccaccagtttgtgaagtgctgatccctcttccttcccagttgcccttaagaactgagaaaggacaaagtactctaagcagcagagcccacagaggctcgttcctttgacccttgtctcctggtggctatacgaaaccttcacaatctgcatgctggactttattacagcttcccaagccccatcaataaagcccctgttcacgctgcactggtgcatgaaggtgaagtaaggaggcagctactccctccacaaataagaattcgtgcagcagcagttcactccttaggaaaatgaagagtatttttaaggagatggtatctccccagtcaagggcaagtttacagagatgaaaccgcgatcccaccatcactcaatgagccagaagccaatggtgacgtactgttacctgaacttactgaacttgctgttggaaagatctttgtgaggattaggaattaggttaaaagaaattaagaaccatcttcaagcaaaaattaaactttatttctgcttaaacaataaatacacctgagttagttttccaaacctttcctcctgattaaatgcccttaaaacttaaa

SEQ ID NO: 369280 - DNA, 728 bp, Homo sapiens
acgacgcgccggaaagcaacggcaagggccgcagccagcaccgggcggagagggctaccatggggaaaatcgcgctgcaactcaaagccacgctggagaacatcaccaacctccggcccgtgggcgaggacttccggtggtacctgaagatgaaatgtggcaactgtggtgagatttcggacaagtggcagtacatccggctgatggacagtgtggcactgaaggggggccgtggcagtgcttccatggtccagaagtgcaagctgtgtgcaagagaaaattccatcgagattttaagcagcaccatcaagccttacaatgctgaagacaatgagaacttcaagacaatagtggagtttgagtgccggggccttgaaccagttgatttccagccgcaggctgggtttgctgctgaaggtgtggagtcagggacagccttcagtgacattaatctgcaggagaaggactggactgactatgatgaaaaggcccaggagtctgtgggaatctatgaggtcacccaccagtttgtgaagtgctgatccctcttccttcccagttgcccttaagaactgagaaaggacaaagtactctaagcagcagagcccacagaggctcgttcctttgacccttgtctcctggtggctatacgaaaccttcacaatctgcatgctggactttattacagcttcccaagccccatcaataaagcccctgttcacgctgca

SEQ ID NO: 369281 - DNA, 893 bp, Homo sapiens
acgacgcgccggaaagcaacggcaagggccgcagccagcaccgggcggagagggctaccatggggaaaatcgcgctgcaactcaaagccacgctggagaacatcaccaacctccggcccgtgggcgaggacttccggtggtacctgaagatgaaatgtggcaactgtggtgagatttcggacaagtggcagtacatccggctgatggacagtgtggcactgaaggggggccgtggcagtgcttccatggtccagaagtgcaagctgtgtgcaagagaaaattccatcgagattttaagcagcaccatcaagccttacaatgctgaagacaatgagaacttcaagacaatagtggagtttgagtgccggggccttgaaccagttgatttccagccgcaggctgggtttgctgctgaaggtgtggagtcagggacagccttcagtgacattaatctgcaggagaaggactggactgactatgatgaaaaggcccaggagtctgtgggaatctatgaggtcacccaccagtttgtgaagtgctgatccctcttccttcccagttgcccttaagaactgagaaaggacaaagtactctaagcagcagagcccacagaggctcgttcctttgacccttgtctcctggtggctatacgaaaccttcacaatctgcatgctggactttattacagcttcccaagccccatcaataaagcccctgttcacgctgcaaaaaaaaaaaaaaagtaaaaaggacaaaaagaggggggggcgcaaaggaacccggggggcaggtaggagcagtttggaaggggcccagggggggaaaaaaggagggggaaaaagggaggggaaagctgggcggggaacccccgtgggagggagaacccaagaggg

SEQ ID NO: 369282 - DNA, 2446 bp, Homo sapiens
acgacgcgccggaaagcaacggcaagggccgcagccagcaccgggcggagagggctaccatggggaaaatcgcgctgcaactcaaagccacgctggagaacatcaccaacctccggcccgtgggcgaggacttccggtggtacctgaagatgaaatgtggcaactgtggtgagatttcggacaagtggcagtacatccggctgatggacagtgtggcactgaaggggggccgtggcagtgcttccatggtccagaagtgcaagctgtgtgcaagagaaaattccatcgagattttaagcagcaccatcaagccttacaatgctgaagacaatgagaacttcaagacaatagtggagtttgagtgccggggccttgaaccagttgatttccagccgcaggctgggtttgctgctgaaggtgtggagtcagggacagccttcagtgacattaatctgcaggagaaggactggactgactatgatgaaaaggcccaggagtctgtgggaatctatgaggtcacccaccagtttgtgaagtgctgatccctcttccttcccagttgcccttaagaactgagaaaggacaaagtactctaagcagcagagcccacagaggctcgttcctttgacccttgtctcctggtggctatacgaaaccttcacaatctgcatgctggactttattacagcttcccaagccccatcaataaagcccctgttcacgctgcactggtgcatgaaggtgaagtaaggaggcagctactccctccacaaataagaattcgtgcagcagcagttcactccttaggaaaatgaagagtatttttaaggagatggtatctccccagtcaagggcaagtttacagagatgaaaccgcgatcccaccatcactcaatgagccagaagccaatggtgacgtactgttacctgaacttactgaacttgctgttggaaagatctttgtgaggattaggaattaggttaaaagaaattaagaaccatcttcaagcaaaaattaaactttatttctgcttaaacaataaatacacctgagttagttttccaaacctttcctcctgattaaatgcccttaaaacttaaatctcttgttatcttcagttgtgatctagtcccaagtggaaattacgtttagctttaaaaccatgaatttaaagctcaagcctgtagctggctgcctaggcagcttatgattagtttcacagaatagcacccactggctacacaggccccagtttttttttcttttttgtttttttgagacagtctcgctctgtcgcccaggccggagtgcagtggtgtgatctcagctcactgcaacctccactcctggggttcaagcaattctgcttcaacctcccaagtagctgggattataggcacatgccaccacacccagctaatttttgtatttttagtagagacaaggtttcaccatgttggccaggttggtctcaaactcctgacctcaagtgatccacccgcctcagcctctcaaaatgctgggattacaggcatgagccaccatgcccggcctcccagttttcatgatgaggaagtgatggtagcttttcatctgcccagaagttaacttttgatggatttgccttctaaggcatcaaacatgtcttctaaggccttctccacacattggagaaactcccgggcattgcggcctgggtaggaagagacattgcagcctatccagttgtcatgaacagcatacccaacaccaaagccatcagagaccacaggggcaaagcccccaaggttcactgctgggctgctcagtgtgctcgtggacaggacattgtggtttatctgcccgtatgcagggtccaggtagagctcaggcaagatgatccctttggctgctgccagatgccgcagagcaaacaagtgtcggtcaaagccctggcctgtgagaaacaaaatggaaaaccagagtctcaggatggaaaaggacctcaggaaaacctcccaactcaccacatggtaggaatacccctcacagcatccttgagagtgggggaaggctctacctctatgcacaccaccaactgactaaccttcagagcagctcaagctagattattttaaattatttaggaaatatattatgtcatgttacatttaaaaatagctgtcaacagctgagctaaaaatgagcctaaaaggaaagcataattttaaagatgtgaaatcagtttagtcaaagagtcaagacagtacaggaagacagctatggactcaaaaactacaataaaactaaaagtctgattcaagtgtaaaagagaagattgagtcagtggaacaaaatggaaagtctgtttgaccagggttcgaatctcagtcttactactaacttgctgtgtaacggggccagtggcttggttttctccctataaaatggaggaagagaagatta

SEQ ID NO: 369283 - DNA, 2808 bp, Homo sapiens
acgacgcgccggaaagcaacggcaagggccgcagccagcaccgggcggagagggctaccatggggaaaatcgcgctgcaactcaaagccacgctggagaacatcaccaacctccggcccgtgggcgaggacttccggtggtacctgaaggtgcggccggggcggggcccggggagaggaggcccgtcctgatctcagtgctgaaccggagccttctctccggcagtatgagaaaatatttaaccaggcacattaagtgttcggggttttcctagttagaattttacgtttgctttctattaaagtgtattggtttatctctaattggcagtcttggaaagcttcattttgtagttcttccctgtgttaaatatttcgtggtctgtaaatggacactaaacgaaatgctacttgaagggacgcttgtgattatttaataaggtgaatagttcgcctttcgtttattgatttggttttctttattgtgaaatagtttaattttgtgcgtaatccacccttccttagccctcccacactggtaaagctggtaccctagtggcatggtctacagaggcctccccttccccagcagttcgaggctcttcactcttccagatcccagagcttctgctctgttttactcctggtcaaaaatcccagcatccttctgtacctctcaaaagccctgttttcgggaagctgcctccggactacttttgtttcccaggattttgaagcctgaataccagggcttacttgggagaatctgttctttggcttgaagaagcggaatcgagtgaaggagacagaaaaatagagtaacaatagagtgataagtgcttataccagtgacatacagggcctgtgggaacataaagctaaccaagcagagtgggtcgggggcctgctgaggccatttctctttttttttcttaattgacacagaattgtacatatttatggggtatatagtgatgttccgataaatgtaatgtattgtgatcagatcaaggtagttagcatattcacctcaaacgtgtatcatttctttgtgttgggagcatttaatatcctagctatttgaaactatatattattgtcagctatagtcatcctacagtgctatagaacactagaacttattcctcccatatagctgtaattttgtatcttctaacaaatctctccatattcccccccctcacctccgctgaaaccatttctgcaccacaggtgccttgaatccccggccacactgagcacttcatagaggagggtgggcacgccggcataggaaacagccttacctatcctttgcccagagatagttctagttttgtccttgttggggcaggtgttagggatgaagtgagattgccatcaagaaggtagatcatgagcctgcccacctcccactgttcttaccctttccttggtgtctgtgcagcagagccagctgctttactaacattcttttccccaaagatgaaatgtggcaactgtggtgagatttcggacaagtggcagtacatccggctgatggtaactgttccccgcccaacccccaacataaacactcacaaacacacatacacttctgggcagggatttggggaaactggccttcatctctccagttctttgctccctgctttttgtggtttgggagggtaggtgtcagtgtgatcagcactggattcaataggcatctttgaggtatgaggcagagttcaaaatcaaggggaagccctttttttattttcctcaggaagccttcccaggagtcttgtcctagtaagttaccctttctgggtcttggtctctttaagtggacaataaatggtgggctcgatctcctcaggactgtacatctaattcatatgtgactgaaagttctgtttgctttttgccaggacagtgtggcactgaaggggggccgtggcagtgcttccatggtccagaagtgcaagctgtgtgcaagagaaaattccatcgagattttaagcagcaccatcaagccttacaatgctgaagacaatgagaacttcaagacaatagtggagtttgagtgccggggccttgaaccagttgatttccagccgcaggctgggtttgctgctgaaggtgtggagtcagggacagccttcagtgacattaatctgcaggagaaggactggactgactatgatgaaaaggcccaggagtctgtgggaatctatgaggtcacccaccagtttgtgaagtgctgatccctcttccttcccagttgcccttaagaactgagaaaggacaaagtactctaagcagcagagcccacagaggctcgttcctttgacccttgtctcctggtggctatacgaaaccttcacaatctgcatgctggactttattacagcttcccaagccccatcaataaagcccctgttcacgctgcactggtgcatgaaggtgaagtaaggaggcagctactccctccacaaataagaattcgtgcagcagcagttcactccttaggaaaatgaagagtatttttaaggagatggtatctccccagtcaagggcaagtttacagagatgaaaccgcgatcccaccatcactcaatgagccagaagccaatggtgacgtactgttacctgaacttactgaacttgctgttggaaagatctttgtgaggattaggaattaggttaaaagaaattaagaaccatcttcaagcaaaaattaaactttatttctgcttaaacaataaatacacctgagttagttttccaaacctttcctcctgattaaatgcccttaaaacttaaa

SEQ ID NO: 369284 - DNA, 1045 bp, Homo sapiens
acgacgcgccggaaagcaacggcaagggccgcagccagcaccgggcggagagggctaccatggggaaaatcgcgctgcaactcaaagccacgctggagaacatcaccaacctccggcccgtgggcgaggacttccggtggtacctgaaggacagtgtggcactgaaggggggccgtggcagtgcttccatggtccagaagtgcaagctgtgtgcaagagaaaattccatcgagattttaagcagcaccatcaagccttacaatgctgaagacaatgagaacttcaagacaatagtggagtttgagtgccggggccttgaaccagttgatttccagccgcaggctgggtttgctgctgaaggtgtggagtcagggacagccttcagtgacattaatctgcaggagaaggactggactgactatgatgaaaaggcccaggagtctgtgggaatctatgaggtcacccaccagtttgtgaagtgctgatccctcttccttcccagttgcccttaagaactgagaaaggacaaagtactctaagcagcagagcccacagaggctcgttcctttgacccttgtctcctggtggctatacgaaaccttcacaatctgcatgctggactttattacagcttcccaagccccatcaataaagcccctgttcacgctgcactggtgcatgaaggtgaagtaaggaggcagctactccctccacaaataagaattcgtgcagcagcagttcactccttaggaaaatgaagagtatttttaaggagatggtatctccccagtcaagggcaagtttacagagatgaaaccgcgatcccaccatcactcaatgagccagaagccaatggtgacgtactgttacctgaacttactgaacttgctgttggaaagatctttgtgaggattaggaattaggttaaaagaaattaagaaccatcttcaagcaaaaattaaactttatttctgcttaaacaataaatacacctgagttagttttccaaacctttcctcctgattaaatgcccttaaaacttaaa

SEQ ID NO: 369285 - DNA, 837 bp, Homo sapiens
atctagaggatcctccattaacaggctgatgcgcgcaccatcaagccttacaagtgctgaagacaatgagaacttcaagacaatagtggagtttgagtgccggggccttgaaccagttgatttccagccgcaggctgggtttgctgctgaaggtgtggagtcagggacagccttcagtgacattaatctgcaggagaaggactggactgactatgatgaaaaggcccaggagtctgtgggaatctatgaggtcacccaccagtttgtgaagtgctgatccctcttccttcccagttgcccttaagaactgagaaaggacaaagtactctaagcagcagagcccacagaggctcgttcctttgacccttgtctcctggtggctatacgaaaccttcacaatctgcatgctggactttattacagcttcccaagccccatcaataaagcccctgttcacgctgcactggtgcatgaaggtgaagtaaggaggcagctactccctccacaaataagaattcgtgcagcagcagttcactccttaggaaaatgaagagtatttttaaggagatggtatctccccagtcaagggcaagtttacagagatgaaaccgcgatcccaccatcactcaatgagccagaagccaatggtgacgtactgttacctgaacttactgaacttgctgttggaaagatctttgtgaggattaggaattaggttaaaagaaattaagaaccatcttcaagcaaaaattaaactttatttctgcttaaacaataaatacacctgagttagttttccaaacctttcctcctgattaaatgcccttaaaacttaaa

SEQ ID NO: 369286 - DNA, 857 bp, Homo sapiens
tgaagcactgaggcccggctgcagacctctcccgagaggggaataatccgtgccggccggttccgccatggagccaggtgcaggtcacctcgacggtcaccgcgcggggagcccaagccttcgtcaggctctgtgcgacggaagcgcagtgatgttttccagtaaagaacgcggacgttgcaccgtgatcaattttgtccctttggaggcgccgttacggtccacgccccgctcgcgtcaagtgactgaggcctgtggtggagaaggacgtgccgtgccgctgggttctgagccggagtggtcggtgggtgggatggaggcgaccttggagcagcacttggaagacacaatgaagaatccctccattgttggagtcctgtgcacagattcacaaggacttaatctgggttgccgcgggaccctgtcagatgagcatgctggagtgatatctgttctagcccagcaagcagctaagctaacctctgaccccactgatattcctgtggtgtgtctagaatcagataatgggaacattatgatccagaaacacgatggcatcacggtggcagtgcacaaaatggcctcttgatgctcatatctgttcttcagcagcctgtcataggaactggatcctacctatgttaattaccttatagaactactaaagttccagtagttaggccattcatttaatgtgcattaggcacttttctgtttatttaagagtcaattgctttctaatgctctatggaccgactatcaagatattagtaagaaaggatcatgttttgaagcagcaggtccaggtcactttgtatatagaattttgctgtattcaataaatctgtttggaggaa

SEQ ID NO: 369287 - DNA, 913 bp, Homo sapiens
tgaagcactgaggcccggctgcagacctctcccgagaggggaataatccgtgccggccggttccgccatggagccaggtgcaggtcacctcgacggtcaccgcgcggggagcccaagccttcgtcaggctctgtgcgacggaagcgcagtgatgttttccagtaaagaacgcggacgttgcaccgtgatcaattttgtccctttggaggcgccgttacggtccacgccccgctcgcgtcaagtgactgaggcctgtggtggagaaggacgtgccgtgccgctgggttctgagccggagtggtcggtgggtgggatggaggcgaccttggagcagcacttggaagacacaatgaagaatccctccattgttggagtcctgtgcacagattcacaaggacttaatctgggttgccgcgggaccctgtcagatgagcatgctggagtgatatctgttctagcccagcaagcagctaagctaacctctgaccccactgatattcctgtggtgtgtctagaatcagataatgggaacattatgatccagaaacacgatggcatcacggtggcagtgcacaaaatggcctcttgatgctcatatctgttcttcagcagcctgtcataggaactggatcctacctatgttaattaccttatagaactactaaagttccagtagttaggccattcatttaatgtgcattaggcacttttctgtttatttaagagtcaattgctttctaatgctctatggaccgactatcaagatattagtaagaaaggatcatgttttgaagcagcaggtccaggtcactttgtatatagaattttgctgtattcaataaatctgtttggaggaaaatggatcttttctagattctttaaacttaaccaaatgttccttttgttcagttat

SEQ ID NO: 369288 - DNA, 889 bp, Homo sapiens
tgaagcactgaggcccggctgcagacctctcccgagaggggaataatccgtgccggccggttccgccatggagccaggtgcaggtcacctcgacggtcaccgcgcggggagcccaagccttcgtcaggctctgtgcgacggaagcgcagtgatgttttccagtaaagaacgcggacgttgcaccgtgatcaattttgtccctttggaggcgccgttacggtccacgccccgctcgcgtcaagtgactgaggcctgtggtggagaaggacgtgccgtgccgctgggttctgagccggagtggtcggtgggtgggatggaggcgaccttggagcagcacttggaagacacaatgaagaatccctccattgttggagtcctgtgcacagattcacaaggacttaatctgggttgccgcgggaccctgtcagatgagcatgctggagtgatatctgttctagcccagcaagcagctaagctaacctctgaccccactgatattcctgtggtgtgtctagaatcagataatgggaacattatgatccagaaacacgatggcatcacggtggcagtgcacaaaatggcctcttgatgctcatatctgttcttcagcagcctgtcataggaactggatcctacctatgttaattaccttatagaactactaaagttccagtagttaggccattcatttaatgtgcattaggcacttttctgtttatttaagagtcaattgctttctaatgctctatggaccgactatcaagatattagtaagaaaggatcatgttttgaagcagcaggtccaggtcactttgtatatagaattttgctgtattcaataaatctgtttggaggaacacaaagaacccagggcctgtggcctccgtgt

SEQ ID NO: 369289 - DNA, 953 bp, Homo sapiens
tgaagcactgaggcccggctgcagacctctcccgagaggggaataatccgtgccggccggttccgccatggagccaggtgcaggtcacctcgacggtcaccgcgcggggagcccaagccttcgtcaggctctgtgcgacggaagcgcagtgatgttttccagtaaagaacgcggacgttgcaccgtgatcaattttgtccctttggaggcgccgttacggtccacgccccgctcgcgtcaagtgactgaggcctgtggtggagaaggacgtgccgtgccgctgggttctgagccggagtggtcggtgggtgggatggaggcgaccttggagcagcacttggaagacactatctatgtaaaattcaaaactggaaaagtataaagggtacagagagacacctgcctcccaccgatgtccctcagcttccacttaccctccaggagaatgaagaatccctccattgttggagtcctgtgcacagattcacaaggacttaatctgggttgccgcgggaccctgtcagatgagcatgctggagtgatatctgttctagcccagcaagcagctaagctaacctctgaccccactgatattcctgtggtgtgtctagaatcagataatgggaacattatgatccagaaacacgatggcatcacggtggcagtgcacaaaatggcctcttgatgctcatatctgttcttcagcagcctgtcataggaactggatcctacctatgttaattaccttatagaactactaaagttccagtagttaggccattcatttaatgtgcattaggcacttttctgtttatttaagagtcaattgctttctaatgctctatggaccgactatcaagatattagtaagaaaggatcatgttttgaagcagcaggtccaggtcactttgtatatagaattttgctgtattcaataaatctgtttggaggaa

SEQ ID NO: 369290 - DNA, 1467 bp, Homo sapiens
tgaagcactgaggcccggctgcagacctctcccgagaggggaataatccgtgccggccggttccgccatggagccaggtgcaggtcacctcgacggtcaccgcgcggggagcccaagccttcgtcaggctctgtgcgacggaagcgcagtgatgttttccagtaaagaacgcggacgttgcaccgtgatcaattttgtccctttggaggcgccgttacggtccacgccccgctcgcgtcaagtgactgaggcctgtggtggagaaggacgtgccgtgccgctgggttctgagccggagtggtcggtgggtgggatggaggcgaccttggagcagcacttggaagacacgtgagtagtgcgcgcctcttcggcctgtcctgaggtcgcggcggaggaacttgagcggaacgaaaggcgcgagctgcgagtaccggccagggcgtctcggggacgtcgcgcgacccccgggacacgggatgagggggctaaactctacccaaggccgcagggcggggcgggtgacccggaattaaaatcctgccgggcaccgcacattccctcttgagcgagtctcccgggcccaggccacgggccaaaactgcctatctcgttgttgaaatcgtctttacggtcagggtggttctgcggaagttttagaaaacgggttgacttttgggaagattgtgccagttgtgcagagtcgagccctgcagtgtaaacaaacacgtatctcctgtgtgtaacctatcagttacttggttgcttaagtagataaaaatcattctttaaatttttcgaacaagcagtatctatgtaaaattcaaaactggaaaagtataaagggtacagagagacacctgcctcccaccgatgtccctcagcttccacttaccctccaggagaatgaagaatccctccattgttggagtcctgtgcacagattcacaaggacttaatctgggttgccgcgggaccctgtcagatgagcatgctggagtgatatctgttctagcccagcaagcagctaagctaacctctgaccccactgatattcctgtggtgtgtctagaatcagataatgggaacattatgatccagaaacacgatggcatcacggtggcagtgcacaaaatggcctcttgatgctcatatctgttcttcagcagcctgtcataggaactggatcctacctatgttaattaccttatagaactactaaagttccagtagttaggccattcatttaatgtgcattaggcacttttctgtttatttaagagtcaattgctttctaatgctctatggaccgactatcaagatattagtaagaaaggatcatgttttgaagcagcaggtccaggtcactttgtatatagaattttgctgtattcaataaatctgtttggaggaaaatggatcttttctagattctttaaacttaaccaaatgttccttttgttcagttat

SEQ ID NO: 369291 - DNA, 1230 bp, Homo sapiens
tgaagcactgaggcccggctgcagacctctcccgagaggggaataatccgtgccggccggttccgccatggagccaggtgcaggtcacctcgacggtcaccgcgcggggagcccaagccttcgtcaggctctgtgcgacggaagcgcagtgatgttttccagtaaagaacgcggacgttgcaccgtgatcaattttgtccctttggaggcgccgttacggtccacgccccgctcgcgtcaagtgactgaggcctgtggtggagaaggacgtgccgtgccgctgggttctgagccggagtggtcggtgggtgggatggaggcgaccttggagcagcacttggaagacacaatgaagaatccctccattgttggagtcctgtgcacagattcacaaggacttaatctgggttgccgcgggaccctgtcagatgagcatgctggagtgatatctgttctagcccagcaagcagctaagctaacctctgaccccactgatattcctgtggtgtgtctagaatcagataatgggaacattatgatccagaaacacgatggcatcacggtggcagtgcacaaaatggcctcttgatgctcatatctgttcttcagcagcctgtcataggaactggatcctacctatgttaattaccttatagaactactaaagttccagtagttaggccattcatttaatgtgcattaggcacttttctgtttatttaagagtcaattgctttctaatgctctatggaccgactatcaagatattagtaagaaaggatcatgttttgaagcagcaggtccaggtcactttgtatatagaattttgctgtattcaataaatctgtttggaggaaaaaaaaaaaaaaaaaaaaaaaaaaaaaaaaaaaaaaaaaaaaaaaaaaaacacaaacaaacacaaacaaaacaaacacaaaaaacaaaaacaaaccaaaaaccccacccacccacgaatacaaagcaagacacacaaccagcaacaccggataaagtaagagcaagcgcacggcgcacacaaaacaaggaaagcccgacagaagaacacctaccacgcaaaaacatataaacacaaccggccgcgacggcacgagcaggccacacaccctcgccacaggccaagaccgcccacgcgccaaccacaccgacccaccgccaacgcaggacacgacccaacccaagcccctccccacacaccgacccaagcccgca

SEQ ID NO: 369292 - DNA, 939 bp, Homo sapiens
cagttatgtttaacatgcagatcagtcatttgggagaaaaagggtaaatttttggaagcatttgctaggcttactaatggaaagactgaaattcaggtatggaaatctaaaactaaatgagttccttcaagaaaccttcaaggctcaaacgtcggcatcggatctggtcaaaatgttttgtatagtaatagtacatccaaatgctctgccatagtggcatgtctattacctgatttggtttcaggtacagttaactttgtgttgcctttatatacagaaatatattgtaaagtacacttagtaattaattttcgtacctagaatttataggtacttttgtacccgagatttagttactataatatatacagactaatacagacattaataaaaagacaattctgtagacattttatatatcatctctattttccaggccgcgggaccctgtcagatgagcatgctggagtgatatctgttctagcccagcaagcagctaagctaacctctgaccccactgatattcctgtggtgtgtctagaatcagataatgggaacattatgatccagaaacacgatggcatcacggtggcagtgcacaaaatggcctcttgatgctcatatctgttcttcagcagcctgtcataggaactggatcctacctatgttaattaccttatagaactactaaagttccagtagttaggccattcatttaatgtgcattaggcacttttctgtttatttaagagtcaattgctttctaatgctctatggaccgactatcaagatattagtaagaaaggatcatgttttgaagcagcaggtccaggtcactttgtatatagaattttgctgtattcaataaatctgtttggaggaaaatggatcttttctagattctttaaacttaaccaaatgttccttttgttcagttat

SEQ ID NO: 369293 - DNA, 886 bp, Homo sapiens
tgaagcactgaggcccggctgcagacctctcccgagaggggaataatccgtgccggccggttccgccatggagccaggtgcaggtcacctcgacggtcaccgcgcggggagcccaagccttcgtcaggctctgtgcgacggaagcgcagtgatgttttccagtaaagaacgcggacgttgcaccgtgatcaattttgtccctttggaggcgccgttacggtccacgccccgctcgcgtcaagtgactgaggcctgtggtggagaaggacgtgccgtgccgctgggttctgagccggagtggtcggtgggtgggatggaggcgaccttggagcagcacttggaagacacaatgaagaatccctccattgttggagtcctgtgcacagattcacaaggacttaatctgggttgccgcgggaccctgtcagatgagcatgctggagtgatatctgttctagcccagcaagcagctaagctaacctctgaccccactgatattcctgtggtgtgtctagaatcagataatgggaacattatgatccagaaacacgatggcatcacggtggcagtgcacaaaatggcctcttgatgctcatatctgttcttcagcagcctgtcataggaactggatcctacctatgttaattaccttatagaactactaaagttccagtagttaggccattcatttaatgtgcattaggcacttttctgtttatttaagagtcaattgctttctaatgctctatggaccgactatcaagatattagtaagaaaggatcatgttttgaagcagcaggtccaggtcactttgtatatagaattttgctgtattcaataaatctgtttggaggaaaaaaccccaccccaccataaaactggcgc

SEQ ID NO: 369294 - DNA, 945 bp, Homo sapiens
tgaagcactgaggcccggctgcagacctctcccgagaggggaataatccgtgccggccggttccgccatggagccaggtgcaggtcacctcgacggtcaccgcgcggggagcccaagccttcgtcaggctctgtgcgacggaagcgcagtgatgttttccagtaaagaacgcggacgttgcaccgtgatcaattttgtccctttggaggcgccgttacggtccacgccccgctcgcgtcaagtgactgaggcctgtggtggagaaggacgtgccgtgccgctgggttctgagccggagtggtcggtgggtgggatggaggcgaccttggagcagcacttggaagacacaatgaagaatccctccattgttggagtcctgtgcacagattcacaaggacttaatctgggttgccgcgggaccctgtcagatgagcatgctggagtgatatctgttctagcccagcaagcagctaagctaacctctgaccccactgatattcctgtggtgtgtctagaatcagataatgggaacattatgatccagaaacacgatggcatcacggtggcagtgcacaaaatggcctcttgatgctcatatctgttcttcagcagcctgtcataggaactggatcctacctatgttaattaccttatagaactactaaagttccagtagttaggccattcatttaatgtgcattaggcacttttctgtttatttaagagtcaattgctttctaatgctctatggaccgactatcaagatattagtaagaaaggatcatgttttgaagcagcaggtccaggtcactttgtatatagaattttgctgtattcaataaatctgtttggaggaaaaaaaaacaacaacacccaaccccacaaaccacacaccaccacccgacaccaacacaccacaccacaaaaacccaccacccaaacaag

SEQ ID NO: 369295 - DNA, 988 bp, Homo sapiens
tgaagcactgaggcccggctgcagacctctcccgagaggggaataatccgtgccggccggttccgccatggagccaggtgcaggtcacctcgacggtcaccgcgcggggagcccaagccttcgtcaggctctgtgcgacggaagcgcagtgatgttttccagtaaagaacgcggacgttgcaccgtgatcaattttgtccctttggaggcgccgttacggtccacgccccgctcgcgtcaagtgactgaggcctgtggtggagaaggacgtgccgtgccgctgggttctgagccggagtggtcggtgggtgggatggaggcgaccttggagcagcacttggaagacacaatgaagaatccctccattgttggagtcctgtgcacagattcacaaggacttaatctgggttgccgcgggaccctgtcagatgagcatgctggagtgatatctgttctagcccagcaagcagctaagctaacctctgaccccactgatattcctgtggtgtgtctagaatcagataatgggaacattatgatccagaaacacgatggcatcacggtggcagtgcacaaaatggcctcttgatgctcatatctgttcttcagcagcctgtcataggaactggatcctacctatgttaattaccttatagaactactaaagttccagtagttaggccattcatttaatgtgcattaggcacttttctgtttatttagctattgcacagcttctgaggcacccacaaaaacatcaaattatggagaagtgagtgcatagatatatgaaatcaacatttcaaattggtaatagaatgtccttcttcattaagtagtgatcttttatcaagctgctacaataaaatcggccttttcattcaacatgctacctgttactaaacagaagtcttaggtatcaaaggttatgcccccggaattagctaataacatttgtaagggctggctggacgtccttttatcctct

SEQ ID NO: 369296 - DNA, 2443 bp, Homo sapiens
ggtgcagctgcttccgggcttcgcggctcccggcggctccccaaggccgcggccccgacgctgggcccgggagcggtccccgcgcacagcgcccggacgcgtaggtcccgaagtaggcccgcgctttgcttcgtaactggggatctctgaggacatcttagttctgaccttgtggaggccgcgtctctgctgcgtgttcgcgggccagtcgggccactttgtagaaatcatagccctctaaatcaagggacgaacgctgctggctggagtttgctggacactttcattccacctcctaacaaagagaattcctattccttgaggtcccttggggcagcagttaaagactacacgatccaggagcacctaggacctggggccaccttcctgcccgctttattggatggagcactgcctccccagtttctgggacaccttggggtgtggccttggtgagtgaaacttggggtgctgcctgctgggaaggaaatccggaaacgcagagaggactctctggtggtgacccaggccttgtcagatctgagattcttggaatctcagattgtgggggtgtggatggtgaatgaatttgggtatgcccccctttaccccagaactgaagaggaagcaaactacttgccacacttgaggctgcatgactattcagagaagggaggagccacttctgaattcagagtaggactgcatcaccaggcaaatacctgttctgagccagaaagactctggcttctgaggagatcctgagagtctgagtagtgccaggaagcagcctcagaatttgggggcccattacacaccccagccatgttcctgcgacggcttggtggctggctacctcgcccttggggccgccggaaaccaatgaggcctgacccgccttacccagaacccagacgggtggacagctcctcggagaattcaggaagtgactgggatagtgccccagaaaccatggaagatgtggggcatcccaagactaaggactcgggggcattgagggtttctagggctgcttccgaaccaagcaaggaggagccccaagttgagcagctagggagcaaaagaatggattccctcaagtgggaccagcctatctctagcactcaagagtctgggagactggaggctggaggggccagtcccaaactcagatgggatcatgtggattcaggtggcaccaggagaccaggggtgtcccctgaagggggactgagcgtccctgggccaggagccccattggagaaacctggtaggcgtgagaagctgttgggctggctgcggggggaaccaggagctccctcccggtacttggggggcccagaagagtgtctgcagatctccaccaacctgaccctgcatcttctggagctgctggcctctgccctgctggccctgtgctcacgaccactgcgggcagccttggacacactgggcctgcgtggaccgctgggcctctggctacatggcctactgtccttcctggctgccctgcatgggctccatgctgttctgagcctacttactgcccaccctttgcacttcgcctgcctctttggtctcctgcaggccttggtgctggctgtcagcctccgggagcccaatggggatgaggcggccactgactgggagagtgaggggttggagagggaaggtgaggagcagaggggagacccgggaaaggggctgtgaccgtggggtgggggcaaagggtgaagagagtgtgggctttaggagaaaagtgtgaggcatgacccaaattgtaagcatagggacctcagggatggggaagaaacccgagtacgagggtgcagggccccccttcatacacaggagagaacagaactatttagggtgtttgtgtttatggacagtgagggcactgctcttggattcaccagctgttatttttgcttttacttttctcccaccttcagttttttttttttttccacctccactttttaaaagcaaaaaaaaaaaaaagtatgatggtggtgaataaagaccaaagggtcctctctacctttgaaaactctcctggggtggaggagaccagggcaggatagacagacctctgcagtaagagagtggttgggaaacccagggtgttccttggatctcaggatctgagccatcgagggaagagtggggctgctaggcaagtggattagggggtctggatagggccccacaggtgacagggagcctgcagggcggatctggtgatcatgggagccagagggagtggggacagtgcaggcagtattggcaggagggccagtgcagaagggctggtagctcaggcagtgtgggggaagcactgaagcctgtagtccccacttgggggctaggggtttgctcactcagcaataaataactgtgtcacatcaaatcctaaatataccactacaaagtgagagtt

SEQ ID NO: 369297 - DNA, 2963 bp, Homo sapiens
ggtgcagctgcttccgggcttcgcggctcccggcggctccccaaggccgcggccccgacgctgggcccgggagcggtccccgcgcacagcgcccggacgcgtaggtcccgaagtaggcccgcgctttgcttcgtaactggggatctctgaggacatcttagttctgaccttgtggaggccgcgtctctgctgcgtgttcgcgggccagtcgggccactttgtagaaatcatagccctctaaatcaagggacgaacgctgctggctggagtttgctggacactttcattccacctcctaacaaagagaattcctattccttgaggtcccttggggcagcagttaaagactacacgatccaggagcacctaggacctggggccaccttcctgcccgctttattggatggagcactgcctccccagtttctgggacaccttggggtgtggccttggtgagtgaaacttggggtgctgcctgctgggaaggaaatccggaaacgcagagaggactctctggtggtgacccaggccttgtcagatctgagattcttggaatctcagattgtgggggtgtggatggtgaatgaatttgggtatgcccccctttaccccagaactgaagaggaagcaaactacttgccacacttgaggctgcatgactattcagagaagggaggagccacttctgaattcagagtaggactgcatcaccaggcaaatacctgttctgagccagaaagactctggcttctgaggagatcctgagagtctgagtagtgccaggaagcagcctcagaatttgggggcccattacacaccccagccatgttcctgcgacggcttggtggctggctacctcgcccttggggccgccggaaaccaatgaggcctgacccgccttacccagaacccagacgggtggacagctcctcggagaattcaggaagtgactgggatagtgccccagaaaccatggaagatgtggggcatcccaagactaaggactcgggggcattgagggtttctagggctgcttccgaaccaagcaaggaggagccccaagttgagcagctagggagcaaaagaatggattccctcaagtgggaccagcctatctctagcactcaagagtctgggagactggaggctggaggggccagtcccaaactcagatgggatcatgtggattcaggtggcaccaggagaccaggggtgtcccctgaagggggactgagcgtccctgggccaggagccccattggagaaacctggtaggcgtgagaagctgttgggctggctgcggggggaaccaggagctccctcccggtacttggggggcccagaagagtgtctgcagatctccaccaacctgaccctgcatcttctggagctgctggcctctgccctgctggccctgtgctcacgaccactgcgggcagccttggacacactgggcctgcgtggaccgctgggcctctggctacatggcctactgtccttcctggctgccctgcatgggctccatgctgttctgagcctacttactgcccaccctttgcacttcgcctgcctctttggtctcctgcaggccttggtgctggctgtcagcctccgggagcccaatggggatgaggcggccactgactgggagagtgaggggttggagagggaaggtgaggagcagaggggagacccgggaaaggggctgtgaccgtggggtgggggcaaagggtgaagagagtgtgggctttaggagaaaagtgtgaggcatgacccaaattgtaagcatagggacctcagggatggggaagaaacccgagtacgagggtgcagggccccccttcatacacaggagagaacagaactatttagggtgtttgtgtttatggacagtgagggcactgctcttggattcaccagctgttatttttgcttttacttttctcccaccttcagttttttttttttttccacctccactttttaaaagcaaaaaaaaaaaaaagtatgatggtggtgaataaagaccaaagggtcctctctacctttgaaaactctcctggggtggaggagaccagggcaggatagacagacctctgcagtaagagagtggttgggaaacccagggtgttccttggatctcaggatctgagccatcgagggaagagtggggctgctaggcaagtggattagggggtctggatagggccccacaggtgacagggagcctgcagggcggatctggtgatcatgggagccagagggagtggggacagtgcaggcagtattggcaggagggccagtgcagaagggctggtagctcaggcagtgtgggggaagcactgaagcctgtagtccccacttgggggctaggggtttgctcactcagcaataaataactgtgtcacatcaaatcctaaatataccactacaaagtgagagttactgccactctgttcttactgacaccgtccagctgggagtttaggtggtagaggatccagggggaatgttgaaatgggaggagtgggaatgacgtctggagacaaaccccagaatgagttgaggattgaaaaattatctttattatcttgagtgggagctggagctggaagtctccagcttctccctccaacaactcagctcccattgtacccatctggggacttagatgaagttacaggtcagttattggacagctcacaggccttgatggggggagggaaaaagaaggacagaagggaagtccagggagaaaagcaaagttgatagtaatggggtgggggagaacgtgttctttcattccctgtgtcaaaggggagtctctaaggctcttttccctccacgtatgaccctctgccccctttatccagtgcaaactcagaaacctctcttttgagtagcccagaacccatcctgcctccctcaggtgacatcacagctcttagccacatccctctggtg

SEQ ID NO: 369298 - DNA, 1521 bp, Homo sapiens
ggtgcagctgcttccgggcttcgcggctcccggcggctccccaaggccgcggccccgacgctgggcccgggagcggtccccgcgcacagcgcccggacgcgtaggtcccgaagtaggcccgcgctttgcttcgtaactggggatctctgaggacatcttagttctgaccttgtggaggccgcgtctctgctgcgtgttcgcgggccagtcgggccactttgtagaaatcatagccctctaaatcaagggacgaacgctgctggctggagtttgctggacactttcattccacctcctaacaaagagaattcctattccttgaggtcccttggggcagcagttaaagactacacgatccaggagcacctaggacgtaagagagtggttgggaaacccagggtgttccttggatctcaggatctgagccatcgagggaagagtggggctgctaggcaagtggattagggggtctggatagggccccacaggtgacagggagcctgcagggcggatctggtgatcatgggagccagagggagtggggacagtgcaggcagtattggcaggagggccagtgcagaagggctggtagctcaggcagtgtgggggaagcactgaagcctgtagtccccacttgggggctaggggtttgctcactcagcaataaataactgtgtcacatcaaatcctaaatataccactacaaagtgagagttactgccactctgttcttactgacaccgtccagctgggagtttaggtggtagaggatccagggggaatgttgaaatgggaggagtgggaatgacgtctggagacaaaccccagaatgagttgaggattgaaaaattatctttattatcttgagtgggagctggagctggaagtctccagcttctccctccaacaactcagctcccattgtacccatctggggacttagatgaagttacaggtcagttattggacagctcacaggccttcctaggagtcaataagacgggaggatgtggtgagcgattgtagaggagaaagcgctggtaaccctggcctgtctcattcagcatgattccacctgggcatgagctggaaaagagctcagtcttcatgtcagggcggccttcagttctgagatctgtgctcccttcagtcaggtggtagatccatttccggggcacacagagcccatctttcatgcggatggtagcacgaaggtggagctgcatcggggcagagccagcagccatattgaagacaatgttgtccacagggtcaaaagttgccaactcctccttggtgggagctgcccctgcgataaagtaccactggcccaagtggacctctgggaactccttcccatccacgcccagagttgtcagttgactgtgctcagggcactggtagatggagttaaggataataccatagaagtagagcagagctgcccaaatttggtggaacatcttcaggcaggagggagctggtgctctgtgtgccttaactgctctctcccctactggc

SEQ ID NO: 369299 - DNA, 999 bp, Homo sapiens
  misc_feature (203)..(203): n is a, c, g, or t
  misc_feature (267)..(267): n is a, c, g, or t
  misc_feature (272)..(272): n is a, c, g, or t
  misc_feature (287)..(287): n is a, c, g, or t
  misc_feature (293)..(294): n is a, c, g, or t
  misc_feature (296)..(296): n is a, c, g, or t
  misc_feature (825)..(825): n is a, c, g, or t
  misc_feature (857)..(857): n is a, c, g, or t
  misc_feature (875)..(875): n is a, c, g, or t
  misc_feature (887)..(887): n is a, c, g, or t
  misc_feature (890)..(890): n is a, c, g, or t
  misc_feature (899)..(899): n is a, c, g, or t
  misc_feature (914)..(914): n is a, c, g, or t
  misc_feature (942)..(942): n is a, c, g, or t
  misc_feature (994)..(994): n is a, c, g, or t
aggggatatgtgggagagaggagggtggtgtggaaaattggggggaaggtatttaagaaagagggtatttgtgggaagtttttggatggatttaggggagaaaaaagggtttttgtgaaaaagggttataaggggggggagaagaaggtgttgatgggtaaaagggatgtatataaagggtgattagtgttggtaggaattanatttaggggtgtgtggggtttatggttggttgtggggggggatttaggggtgtttgtagggtgnggttntttggttaattggtnttgttnntnttttttatttttgtttttttttttttttttttttttttttttttttttttttttttgtttttttttttttttttttttttttttttttttttttttttttttttttttttttttttttttttttttttttttttttttttttttttttttttttttttttttttttttttttttttttttgaggattgaaaaattatctttattatcttgagtgggagctggagctggaagtctccagcttctccctccaacaactcagctcccattgtacccatctggggacttagatgaagttacaggtcagttattggacagctcacaggcctcttgattcctaggagtcaataagaaggctttggagtccaggcaggaagtcagggacttgaattcctccacacacttttcgggaggatgtggtgagcgattgtagaggagaaagcgctggtaaccctggcctgtctcattcagcatgattccacctgggcatgagctggaaaagagctcagtcttcatgtcagggcggcctttnaagttcttgaggaatctggggctcccctttcnaattcaaggtgggtaaanatcccaattttnccnggggggaanaaaagaagcccccantctttttccaatgccgggaatggttaancaaccgaaaaggtgggaagcttgcaataccggggggcagcccaagcggcccnttttg

SEQ ID NO: 369300 - DNA, 3248 bp, Homo sapiens
ggtgcagctgcttccgggcttcgcggctcccggcggctccccaaggccgcggccccgacgctgggcccgggagcggtccccgcgcacagcgcccggacgcgtaggtcccgaagtaggcccgcgctttgcttcgtaactggggatctctgaggacatcttagttctgaccttgtggaggccgcgtctctgctgcgtgttcgcgggccagtcgggccactttgtagaaatcatagccctctaaatcaagggacgaacgctgctggctggagtttgctggacactttcattccacctcctaacaaagagaattcctattccttgaggtcccttggggcagcagttaaagactacacgatccaggagcacctaggacctggggccaccttcctgcccgctttattggatggagcactgcctccccagtttctgggacaccttggggtgtggccttggtgagtgaaacttggggtgctgcctgctgggaaggaaatccggaaacgcagagaggactctctggtggtgacccaggccttgtcagatctgagattcttggaatctcagattgtgggggtgtggatggtgaatgaatttgggtatgcccccctttaccccagaactgaagaggaagcaaactacttgccacacttgaggctgcatgactattcagagaagggaggagccacttctgaattcagagtaggactgcatcaccaggcaaatacctgttctgagccagaaagactctggcttctgaggagatcctgagagtctgagtagtgccaggaagcagcctcagaatttgggggcccattacacaccccagccatgttcctgcgacggcttggtggctggctacctcgcccttggggccgccggaaaccaatgaggcctgacccgccttacccagaacccagacgggtggacagctcctcggagaattcaggaagtgactgggatagtgccccagaaaccatggaagatgtggggcatcccaagactaaggactcgggggcattgagggtttctagggctgcttccgaaccaagcaaggaggagccccaagttgagcagctagggagcaaaagaatggattccctcaagtgggaccagcctatctctagcactcaagagtctgggagactggaggctggaggggccagtcccaaactcagatgggatcatgtggattcaggtggcaccaggagaccaggggtgtcccctgaagggggactgagcgtccctgggccaggagccccattggagaaacctggtaggcgtgagaagctgttgggctggctgcggggggaaccaggagctccctcccggtacttggggggcccagaagagtgtctgcagatctccaccaacctgaccctgcatcttctggagctgctggcctctgccctgctggccctgtgctcacgaccactgcgggcagccttggacacactgggcctgcgtggaccgctgggcctctggctacatggcctactgtccttcctggctgccctgcatgggctccatgctgttctgagcctacttactgcccaccctttgcacttcgcctgcctctttggtctcctgcaggccttggtgctggctgtcagcctccgggagcccaatggggatgaggcggccactgactgggagagtgaggggttggagagggaaggtgaggagcagaggggagacccgggaaaggggctgtgaccgtggggtgggggcaaagggtgaagagagtgtgggctttaggagaaaagtgtgaggcatgacccaaattgtaagcatagggacctcagggatggggaagaaacccgagtacgagggtgcagggccccccttcatacacaggagagaacagaactatttagggtgtttgtgtttatggacagtgagggcactgctcttggattcaccagctgttatttttgcttttacttttctcccaccttcagttttttttttttttccacctccactttttaaaagcaaaaaaaaaaaaaagtatgatggtggtgaataaagaccaaagggtcctctctacctttgaaaactctcctggggtggaggagaccagggcaggatagacagacctctgcagtaagagagtggttgggaaacccagggtgttccttggatctcaggatctgagccatcgagggaagagtggggctgctaggcaagtggattagggggtctggatagggccccacaggtgacagggagcctgcagggcggatctggtgatcatgggagccagagggagtggggacagtgcaggcagtattggcaggagggccagtgcagaagggctggtagctcaggcagtgtgggggaagcactgaagcctgtagtccccacttgggggctaggggtttgctcactcagcaataaataactgtgtcacatcaaatcctaaatataccactacaaagtgagagttactgccactctgttcttactgacaccgtccagctgggagtttaggtggtagaggatccagggggaatgttgaaatgggaggagtgggaatgacgtctggagacaaaccccagaatgagttgaggattgaaaaattatctttattatcttgagtgggagctggagctggaagtctccagcttctccctccaacaactcagctcccattgtacccatctggggacttagatgaagttacaggtcagttattggacagctcacaggccttcctaggagtcaataagacgggaggatgtggtgagcgattgtagaggagaaagcgctggtaaccctggcctgtctcattcagcatgattccacctgggcatgagctggaaaagagctcagtcttcatgtcagggcggccttcagttctgagatctgtgctcccttcagtcaggtggtagatccatttccggggcacacagagcccatctttcatgcggatggtagcacgaaggtggagctgcatcggggcagagccagcagccatattgaagacaatgttgtccacagggtcaaaagttgccaactcctccttggtgggagctgcccctgcgataaagtaccactggcccaagtggacctctgggaactccttcccatccacgcccagagttgtcagttgactgtgctcagggcactggtagatggagttaaggataataccatagaagtagagcagagctgcccaaatttggtggaacatcttcaggcaggagggagctggtgctctgtgtgccttaactgctctctcccctactggc

SEQ ID NO: 369301 - DNA, 3086 bp, Homo sapiens
  misc_feature (2912)..(2912): n is a, c, g, or t
  misc_feature (2944)..(2944): n is a, c, g, or t
  misc_feature (2962)..(2962): n is a, c, g, or t
  misc_feature (2974)..(2974): n is a, c, g, or t
  misc_feature (2977)..(2977): n is a, c, g, or t
  misc_feature (2986)..(2986): n is a, c, g, or t
  misc_feature (3001)..(3001): n is a, c, g, or t
  misc_feature (3029)..(3029): n is a, c, g, or t
  misc_feature (3081)..(3081): n is a, c, g, or t
ggtgcagctgcttccgggcttcgcggctcccggcggctccccaaggccgcggccccgacgctgggcccgggagcggtccccgcgcacagcgcccggacgcgtaggtcccgaagtaggcccgcgctttgcttcgtaactggggatctctgaggacatcttagttctgaccttgtggaggccgcgtctctgctgcgtgttcgcgggccagtcgggccactttgtagaaatcatagccctctaaatcaagggacgaacgctgctggctggagtttgctggacactttcattccacctcctaacaaagagaattcctattccttgaggtcccttggggcagcagttaaagactacacgatccaggagcacctaggacctggggccaccttcctgcccgctttattggatggagcactgcctccccagtttctgggacaccttggggtgtggccttggtgagtgaaacttggggtgctgcctgctgggaaggaaatccggaaacgcagagaggactctctggtggtgacccaggccttgtcagatctgagattcttggaatctcagattgtgggggtgtggatggtgaatgaatttgggtatgcccccctttaccccagaactgaagaggaagcaaactacttgccacacttgaggctgcatgactattcagagaagggaggagccacttctgaattcagagtaggactgcatcaccaggcaaatacctgttctgagccagaaagactctggcttctgaggagatcctgagagtctgagtagtgccaggaagcagcctcagaatttgggggcccattacacaccccagccatgttcctgcgacggcttggtggctggctacctcgcccttggggccgccggaaaccaatgaggcctgacccgccttacccagaacccagacgggtggacagctcctcggagaattcaggaagtgactgggatagtgccccagaaaccatggaagatgtggggcatcccaagactaaggactcgggggcattgagggtttctagggctgcttccgaaccaagcaaggaggagccccaagttgagcagctagggagcaaaagaatggattccctcaagtgggaccagcctatctctagcactcaagagtctgggagactggaggctggaggggccagtcccaaactcagatgggatcatgtggattcaggtggcaccaggagaccaggggtgtcccctgaagggggactgagcgtccctgggccaggagccccattggagaaacctggtaggcgtgagaagctgttgggctggctgcggggggaaccaggagctccctcccggtacttggggggcccagaagagtgtctgcagatctccaccaacctgaccctgcatcttctggagctgctggcctctgccctgctggccctgtgctcacgaccactgcgggcagccttggacacactgggcctgcgtggaccgctgggcctctggctacatggcctactgtccttcctggctgccctgcatgggctccatgctgttctgagcctacttactgcccaccctttgcacttcgcctgcctctttggtctcctgcaggccttggtgctggctgtcagcctccgggagcccaatggggatgaggcggccactgactgggagagtgaggggttggagagggaaggtgaggagcagaggggagacccgggaaaggggctgtgaccgtggggtgggggcaaagggtgaagagagtgtgggctttaggagaaaagtgtgaggcatgacccaaattgtaagcatagggacctcagggatggggaagaaacccgagtacgagggtgcagggccccccttcatacacaggagagaacagaactatttagggtgtttgtgtttatggacagtgagggcactgctcttggattcaccagctgttatttttgcttttacttttctcccaccttcagttttttttttttttccacctccactttttaaaagcaaaaaaaaaaaaaagtatgatggtggtgaataaagaccaaagggtcctctctacctttgaaaactctcctggggtggaggagaccagggcaggatagacagacctctgcagtaagagagtggttgggaaacccagggtgttccttggatctcaggatctgagccatcgagggaagagtggggctgctaggcaagtggattagggggtctggatagggccccacaggtgacagggagcctgcagggcggatctggtgatcatgggagccagagggagtggggacagtgcaggcagtattggcaggagggccagtgcagaagggctggtagctcaggcagtgtgggggaagcactgaagcctgtagtccccacttgggggctaggggtttgctcactcagcaataaataactgtgtcacatcaaatcctaaatataccactacaaagtgagagttactgccactctgttcttactgacaccgtccagctgggagtttaggtggtagaggatccagggggaatgttgaaatgggaggagtgggaatgacgtctggagacaaaccccagaatgagttgaggattgaaaaattatctttattatcttgagtgggagctggagctggaagtctccagcttctccctccaacaactcagctcccattgtacccatctggggacttagatgaagttacaggtcagttattggacagctcacaggcctcttgattcctaggagtcaataagaaggctttggagtccaggcaggaagtcagggacttgaattcctccacacacttttcgggaggatgtggtgagcgattgtagaggagaaagcgctggtaaccctggcctgtctcattcagcatgattccacctgggcatgagctggaaaagagctcagtcttcatgtcagggcggcctttnaagttcttgaggaatctggggctcccctttcnaattcaaggtgggtaaanatcccaattttnccnggggggaanaaaagaagcccccantctttttccaatgccgggaatggttaancaaccgaaaaggtgggaagcttgcaataccggggggcagcccaagcggcccnttttg

SEQ ID NO: 369302 - DNA, 3201 bp, Homo sapiens
ggtgcagctgcttccgggcttcgcggctcccggcggctccccaaggccgcggccccgacgctgggcccgggagcggtccccgcgcacagcgcccggacgcgtaggtcccgaagtaggcccgcgctttgcttcgtaactggggatctctgaggacatcttagttctgaccttgtggaggccgcgtctctgctgcgtgttcgcgggccagtcgggccactttgtagaaatcatagccctctaaatcaagggacgaacgctgctggctggagtttgctggacactttcattccacctcctaacaaagagaattcctattccttgaggtcccttggggcagcagttaaagactacacgatccaggagcacctaggacctggggccaccttcctgcccgctttattggatggagcactgcctccccagtttctgggacaccttggggtgtggccttggtgagtgaaacttggggtgctgcctgctgggaaggaaatccggaaacgcagagaggactctctggtggtgacccaggccttgtcagatctgagattcttggaatctcagattgtgggggtgtggatggtgaatgaatttgggtatgcccccctttaccccagaactgaagaggaagcaaactacttgccacacttgaggctgcatgactattcagagaagggaggagccacttctgaattcagagtaggactgcatcaccaggcaaatacctgttctgagccagaaagactctggcttctgaggagatcctgagagtctgagtagtgccaggaagcagcctcagaatttgggggcccattacacaccccagccatgttcctgcgacggcttggtggctggctacctcgcccttggggccgccggaaaccaatgaggcctgacccgccttacccagaacccagacgggtggacagctcctcggagaattcaggaagtgactgggatagtgccccagaaaccatggaagatgtggggcatcccaagactaaggactcgggggcattgagggtttctagggctgcttccgaaccaagcaaggaggagccccaagttgagcagctagggagcaaaagaatggattccctcaagtgggaccagcctatctctagcactcaagagtctgggagactggaggctggaggggccagtcccaaactcagatgggatcatgtggattcaggtggcaccaggagaccaggggtgtcccctgaagggggactgagcgtccctgggccaggagccccattggagaaacctggtaggcgtgagaagctgttgggctggctgcggggggaaccaggagctccctcccggtacttggggggcccagaagagtgtctgcagatctccaccaacctgaccctgcatcttctggagctgctggcctctgccctgctggccctgtgctcacgaccactgcgggcagccttggacacactgggcctgcgtggaccgctgggcctctggctacatggcctactgtccttcctggctgccctgcatgggctccatgctgttctgagcctacttactgcccaccctttgcacttcgcctgcctctttggtctcctgcaggccttggtgctggctgtcagcctccgggagcccaatggggatgaggcggccactgactgggagagtgaggggttggagagggaaggtgaggagcagaggggagacccgggaaaggggctgtgaccgtggggtgggggcaaagggtgaagagagtgtgggctttaggagaaaagtgtgaggcatgacccaaattgtaagcatagggacctcagggatggggaagaaacccgagtacgagggtgcagggccccccttcatacacaggagagaacagaactatttagggtgtttgtgtttatggacagtgagggcactgctcttggattcaccagctgttatttttgcttttacttttctcccaccttcagttttttttttttttccacctccactttttaaaagcaaaaaaaaaaaaaagtatgatggtggtgaataaagaccaaagggtcctctctacctttgaaaagtaagagagtggttgggaaacccagggtgttccttggatctcaggatctgagccatcgagggaagagtggggctgctaggcaagtggattagggggtctggatagggccccacaggtgacagggagcctgcagggcggatctggtgatcatgggagccagagggagtggggacagtgcaggcagtattggcaggagggccagtgcagaagggctggtagctcaggcagtgtgggggaagcactgaagcctgtagtccccacttgggggctaggggtttgctcactcagcaataaataactgtgtcacatcaaatcctaaatataccactacaaagtgagagttactgccactctgttcttactgacaccgtccagctgggagtttaggtggtagaggatccagggggaatgttgaaatgggaggagtgggaatgacgtctggagacaaaccccagaatgagttgaggattgaaaaattatctttattatcttgagtgggagctggagctggaagtctccagcttctccctccaacaactcagctcccattgtacccatctggggacttagatgaagttacaggtcagttattggacagctcacaggccttcctaggagtcaataagacgggaggatgtggtgagcgattgtagaggagaaagcgctggtaaccctggcctgtctcattcagcatgattccacctgggcatgagctggaaaagagctcagtcttcatgtcagggcggccttcagttctgagatctgtgctcccttcagtcaggtggtagatccatttccggggcacacagagcccatctttcatgcggatggtagcacgaaggtggagctgcatcggggcagagccagcagccatattgaagacaatgttgtccacagggtcaaaagttgccaactcctccttggtgggagctgcccctgcgataaagtaccactggcccaagtggacctctgggaactccttcccatccacgcccagagttgtcagttgactgtgctcagggcactggtagatggagttaaggataataccatagaagtagagcagagctgcccaaatttggtggaacatcttcaggcaggagggagctggtgctctgtgtgccttaactgctctctcccctactggc

SEQ ID NO: 369303 - DNA, 959 bp, Homo sapiens
ttctgtggaagcctcccttgtttcccaacctgtgccactctttatcagatctacatgcccatcttatgtagcattccaccttgtcccattcattattcctgacttgaagccaaaattgtgtgaatccactggttcttttctcatgtgtatgttttgtgccctccgttcaccccagcactcctgtcatgtttgaaatgctggcatgaaatcctcctagagatgtccatcaaaagagttgggaagaggccctggagagaagcatcaggactgggatttgaggtttgacagtacctagaacaagaggagctgataccactgaaaaacagaacagatgttaaaaccatgggatagcacctacttttagctggcataaagtagagaagctgagtagtagtggttgtgaagtataaacgttcactgctgtggtaggtagctaagggaagaattgaaattatttttattgttactatcattttaaagacatatttttgctctattgtccaggctggagggcagtggtgcaatcatagctccctgtagtttcaaactcctgggctcaagtgatccatctcagcctcctcagtatctgggaccatgcctggctaatttttaaatttctgtacagacggagtcttgctacattgcccaggctgttcgtgaactcctggcctcaagcgatccttccaccttggcctctcaaagcactaggattacaggtgtgagccacagcacctggctaagttcagattattaatggccagtggtccctagtgttacagatgccaaatagtaagatgatgaaaagtatggttcagtgggattacaggcatgagccaccgcgcctggcctacacaaaaattcttaattttgagaaagtccagttcatcctgtttttttctttcattgcttatgcttttggtgtcatatgaaataaattattgcaaaatgccacaacttaa

SEQ ID NO: 369304 - DNA, 288 bp, Homo sapiens
  misc_feature (5)..(5): n is a, c, g, or t
  misc_feature (28)..(28): n is a, c, g, or t
  misc_feature (91)..(91): n is a, c, g, or t
tttcnttttaattttttatttttaaaangacagagtcttggctatgtcaccccatgctggagtgaagtgggcatgatcctcagctcactgnaccctccaaccttccccaggttcaagcaattccgccttggcctcccaaagtgctgggattacaggcatgagccaccgcgcctggcctacacaaaaattcttaattttgagaaagtccagttcatcctgtttttttctttcattgcttatgcttttggtgtcatatgaaataaattattgcaaaatgccacaacttaa

SEQ ID NO: 369305 - DNA, 272 bp, Homo sapiens
ctgggactacaggcgtgcatcaccacgcccagctaatttttgtatttttagtagagacggggtttcaccatgttggacaggatggtctcaatctcttgaccttatgatccgcccgccttggcctcccaaagtgctgggattacaggcatgagccaccgcgcctggcctacacaaaaattcttaattttgagaaagtccagttcatcctgtttttttctttcattgcttatgcttttggtgtcatatgaaataaattattgcaaaatgccaca

SEQ ID NO: 369306 - DNA, 482 bp, Homo sapiens
ggaggcatagagggctcggtatagaaatgccattcccctcacgccagtgggtagtcattgagatctgggtgccaagcactgagctggggaacacacttagagagaccaacatgtgtgagggtcccagctccaggaaatggaggtggggtggagaacgcctggagggaggcgtccacaggtgttcctggagtgcagagaactgctgcccactcaggatggtctgagaagatgcagacagaaagtgctccccgggctggatcttgaatcatgaggaaaatcaagtggcctgagtggagaggaagcgctttctaggtgagaagcccgacctgatggagggggatggatcagcaacaaagaaaatcatccaatcccaggaatagccctgtcactgcaccaggaagatgccagggcagagggactctggtggagtcacacacagccggagccagcaggagctctttggagcagcagtgacctgcgtg

SEQ ID NO: 369307 - DNA, 257 bp, Homo sapiens
tgcttgtagtcccacctgtctgtgaggctgaggtgggagcatcacctgagcccaggaggccaagatggatggatcatttgagaccagcctaagcaacatggcaaaaccccatctctacagaaaataacaacaacaacaaaaaattgctgggtgtgatggcacatgcctgtattcccacctatctgtgaggctgaggtggcagcatcatctgagcctgatcacctgatggaggctgcagtgagcctcgatcgcagcac

SEQ ID NO: 369308 - DNA, 840 bp, Homo sapiens
  misc_feature (84)..(84): n is a, c, g, or t
tttatatacagcttgtttgaacagctcaggatcatcctcctctacaatgtaggttttccttccctcccggaccacgtggaagcngcactcaagatgctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccgcaccatgtgtataagaagacagaccattgcaacacggtcattgcaacacggtctctca

SEQ ID NO: 369309 - DNA, 2875 bp, Homo sapiens
tttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatgctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggccccgcctgcctctgagtggtcaggccaagtctgcagggcaaagcccatgggatccctttgggtggggacctgatggctgtgggacgtgcttgggcctggagtcagtgtgggggttaacagagagagagatttgatgctaacgtcccctcaagagtgagggtcatatgagctcttcagcaggcagatgtgggtagcagggccagcctgtgtcaggggcagcccaccaagttaactcactgagtggaagccgccagtgtgccaacgcggaggggacaggccacacccagtgctcagcagctgattcctcatgtaagtggcatcatgtggtatttgttttgtgtctggcttatttctattaacataatgttctccaggttcctccatgttattgcaaatgataggatttctttccttgtaaaaaataacatgccacattttcttaccaatccgtccaccaatagacacttaggtcgttttcatagtttggcagttgtggaaatgctgcagtaaacatgggagtatagctatcttttgaagataatgatttcatctcttttttatatgtatacccagaagtgggattgctgcatcaaatggtggttctatttttaattttttgaggaaccgccatactgttttccataaaggctgtactaatttccattctcaccaacagttcactagggttcccttttctccacattgttgccaacattctttatcttgtgttttttaataacagctatcctaacaggtatgaggtgatctctctcattgcggttttgatttgcatttccctaacggttggtgatactgagcatttttgcatacaccgggtcatttgttctttgttgttgacttgagtcccttatatagtttggatactgctgtggcctgaatgtttgtgtcccccaaaaattcgtatattgaactctcatccctaaggtcaacagtttagggaagcgattaggtcctgaggactctgccctcttgcatagaattagtgctcttataaaagatgcccgagggagctcttttgcccctcctgccatgtgaggacacagctagaagctaccatctgtgaaccaggaagcccccctcaccagacactgaatctgctggagccaccatcttggacttcccagcctccagagctgtgagaaataaatgcctgttgtttaagcta

SEQ ID NO: 369310 - DNA, 2351 bp, Homo sapiens
  misc_feature (40)..(40): n is a, c, g, or t
  misc_feature (58)..(58): n is a, c, g, or t
gaaaaaaaaaaaaagagaaaaggaaaacaggaaacaatangctagtgcgaggccgggnggtaggaagtgaggactgtgtcgcgctggaggagcccacagattctcccggacccacgtggaagcggcactcaagatgctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggccccgcctgcctctgagtggtcaggccaagtctgcagggcaaagcccatgggatccctttgggtggggacctgatggctgtgggacgtgcttgggcctggagtcagtgtgggggttaacagagagagagatttgatgctaacgtcccctcaagagtgagggtcatatgagctcttcagcaggcagatgtgggtagcagggccagcctgtgtcaggggcagcccaccaagttaactcactgagtggaagccgccagtgtgccaacgcggaggggacaggccacacccagtgctcagcagctgattcctcatgtaagtggcatcatgtggtatttgttttgtgtctggcttatttctattaacataatgttctccaggttcctccatgttattgcaaatgataggatttctttccttgtaaaaaataacatgccacattttcttaccaatccgtccaccaatagacacttaggtcgttttcatagtttggcagttgtggaaatgctgcagtaaacatgggagtatagctatcttttgaagataatgatttcatctcttttttatatgtatacccagaagtgggattgctgcatcaaatggtggttctatttttaattttttgaggaaccgccatactgttttccataaaggctgtactaatttccattctcaccaacagttcactagggttcccttttctccacattgttgccaacattctttatcttgtgttttttaataacagctatcctaacaggtatgaggtgatctctctcattgcggttttgatttgcatttccctaacggttggtgatactgagcatttttgcatacaccgggtcatttgttctttgttgttgacttgagtcccttatatagtttggatactgctgtggcctgaatgtttgtgtcccccaaaaattcgtatattgaactctcatccctaaggtcaacagtttagggaagcgattaggtcctgaggactctgccctcttgcatagaattagtgctcttataaaagatgcccgagggagctcttttgcccctcctgccatgtgaggacacagctagaagctaccatctgtgaaccaggaagcccccctcaccagacactgaatctgctggagccaccatcttggacttcccagcctccagagctgtgagaaataaatgcctgttgtttaagcta

SEQ ID NO: 369311 - DNA, 2180 bp, Homo sapiens
tttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatgctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggccccgcctgcctctgagtggtcaggccaagtctgcagggcaaagcccatgggatccctttgggtggggacctgatggctgtgggacgtgcttgggcctggagtcagtgtgggggttaacagagagagagatttgatgctaacgtcccctcaagagtgagggtcatatgagctcttcagcaggcagatgtgggtagcagggccagcctgtgtcaggggcagcccaccaagttaactcactgagtggaagccgccagtgtgccaacgcggaggggacaggccacacccagtgctcagcagctgattcctcatgtaagtggcatcatgtggtatttgttttgtgtctggcttcttatacacatggtgccggaatgatatgtagtcgtcctggtttgcgaaggtgatgacccggtggctatcatctttggcacgggaaataggtatcggaggatgtcagagacccgctgcccagcgggaggagaaccatccatttt

SEQ ID NO: 369312 - DNA, 2902 bp, Homo sapiens
tttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatggtaggagaatgagctcctgtttcggagctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggccccgcctgcctctgagtggtcaggccaagtctgcagggcaaagcccatgggatccctttgggtggggacctgatggctgtgggacgtgcttgggcctggagtcagtgtgggggttaacagagagagagatttgatgctaacgtcccctcaagagtgagggtcatatgagctcttcagcaggcagatgtgggtagcagggccagcctgtgtcaggggcagcccaccaagttaactcactgagtggaagccgccagtgtgccaacgcggaggggacaggccacacccagtgctcagcagctgattcctcatgtaagtggcatcatgtggtatttgttttgtgtctggcttatttctattaacataatgttctccaggttcctccatgttattgcaaatgataggatttctttccttgtaaaaaataacatgccacattttcttaccaatccgtccaccaatagacacttaggtcgttttcatagtttggcagttgtggaaatgctgcagtaaacatgggagtatagctatcttttgaagataatgatttcatctcttttttatatgtatacccagaagtgggattgctgcatcaaatggtggttctatttttaattttttgaggaaccgccatactgttttccataaaggctgtactaatttccattctcaccaacagttcactagggttcccttttctccacattgttgccaacattctttatcttgtgttttttaataacagctatcctaacaggtatgaggtgatctctctcattgcggttttgatttgcatttccctaacggttggtgatactgagcatttttgcatacaccgggtcatttgttctttgttgttgacttgagtcccttatatagtttggatactgctgtggcctgaatgtttgtgtcccccaaaaattcgtatattgaactctcatccctaaggtcaacagtttagggaagcgattaggtcctgaggactctgccctcttgcatagaattagtgctcttataaaagatgcccgagggagctcttttgcccctcctgccatgtgaggacacagctagaagctaccatctgtgaaccaggaagcccccctcaccagacactgaatctgctggagccaccatcttggacttcccagcctccagagctgtgagaaataaatgcctgttgtttaagcta

SEQ ID NO: 369313 - DNA, 2345 bp, Homo sapiens
tttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatgctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaacagctgattcctcatgtaagtggcatcatgtggtatttgttttgtgtctggcttatttctattaacataatgttctccaggttcctccatgttattgcaaatgataggatttctttccttgtcgttttcatagtttggcagttgtggaaatgctgcagtaaacatgggagtatagctatcttttgaagataatgatttcatctcttttttatatgtatacccagaagtgggattgctgcatcaaatggtggttctatttttaattttttgaggaaccgccatactgttttccataaaggctgtactaatttccattctcaccaacagttcactagggttcccttttctccacattgttgccaacattctttatcttgtgttttttaataacagctatcctaacaggtatgaggtgatctctctcattgcggttttgatttgcatttccctaacggttggtgatactgagcatttttgcatacaccgggtcatttgttctttgttgttgacttgagtcccttatatagtttggatactgctgtggcctgaatgtttgtgtcccccaaaaattcgtatattgaactctcatccctaaggtcaacagtttagggaagcgattaggtcctgaggactctgccctcttgcatagaattagtgctcttataaaagatgcccgagggagctcttttgcccctcctgccatgtgaggacacagctagaagctaccatctgtgaaccaggaagcccccctcaccagacactgaatctgctggagccaccatcttggacttcccagcctccagagctgtgagaaataaatgcctgttgtttaagcta

SEQ ID NO: 369314 - DNA, 2311 bp, Homo sapiens
  misc_feature (84)..(84): n is a, c, g, or t
tttatatacagcttgtttgaacagctcaggatcatcctcctctacaatgtaggttttccttccctcccggaccacgtggaagcngcactcaagatgctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggccccgcctgcctctgagtggtcaggccaagtctgcagggcaaagcccatgggatccctttgggtggggacctgatggctgtgggacgtgcttgggcctggagtcagtgtgggggttaacagagagagagatttgatgctaacgtcccctcaagagtgagggtcatatgagctcttcagcaggcagatgtgggtagcagggccagcctgtgtcaggggcagcccaccaagttaactcactgagtggaagccgccagtgtgccaacgcggaggggacaggccacacccagtgctcagcagctgattcctcatgtaagtggcatcatgtggtatttgttttgtgtctggcttatttctattaacataatgttctccaggttcctccatgttattgcaaatgataggatttctttccttgtaaaaaataacatgccacattttcttaccaatccgtccaccaatagacacttaggtcgttttcatagtttggcagttgtggaaatgctgcagtaaacatgggagtatagctatcttttgaagataatgatttcatctcttttttatatgtatacccagaagtgggattgctgcatcaaatggtggttctatttttaattttttgaggaaccgccatactgttttccataaaggctgtactaatttccattctcaccaacagttcactagggttcccttttctccacattgttgccaacattctttatcttgtgttttttaataacagctatcctaacaggtatgaggtgatctctctcattgcggttttgatttgcatttccctaacggttggtgatactgagcatttttgcatacaccgggtcatttgttctttgttgttgacttgagtcccttatatagtttggatactgctgtggcctgaatgtttgtgtcccccaaaaattcgtatattgaactctcatccctaaggtcaacagtttagggaagcgattaggtcctgaggactctgccctcttgcatagaattagtgctcttataaaagatgcccgagggagctcttttgcccctcctgccatgtgaggacacagctagaagctaccatctgtgaaccaggaagcccccctcaccagacactgaatctgctggagccaccatcttggacttcccagcctccagagctgtgagaaataaatgcctgttgtttaagcta

SEQ ID NO: 369315 - DNA, 2187 bp, Homo sapiens
acaatcggtctaggtcgagctgggttgaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggccccgcctgcctctgagtggtcaggccaagtctgcagggcaaagcccatgggatccctttgggtggggacctgatggctgtgggacgtgcttgggcctggagtcagtgtgggggttaacagagagagagatttgatgctaacgtcccctcaagagtgagggtcatatgagctcttcagcaggcagatgtgggtagcagggccagcctgtgtcaggggcagcccaccaagttaactcactgagtggaagccgccagtgtgccaacgcggaggggacaggccacacccagtgctcagcagctgattcctcatgtaagtggcatcatgtggtatttgttttgtgtctggcttatttctattaacataatgttctccaggttcctccatgttattgcaaatgataggatttctttccttgtaaaaaataacatgccacattttcttaccaatccgtccaccaatagacacttaggtcgttttcatagtttggcagttgtggaaatgctgcagtaaacatgggagtatagctatcttttgaagataatgatttcatctcttttttatatgtatacccagaagtgggattgctgcatcaaatggtggttctatttttaattttttgaggaaccgccatactgttttccataaaggctgtactaatttccattctcaccaacagttcactagggttcccttttctccacattgttgccaacattctttatcttgtgttttttaataacagctatcctaacaggtatgaggtgatctctctcattgcggttttgatttgcatttccctaacggttggtgatactgagcatttttgcatacaccgggtcatttgttctttgttgttgacttgagtcccttatatagtttggatactgctgtggcctgaatgtttgtgtcccccaaaaattcgtatattgaactctcatccctaaggtcaacagtttagggaagcgattaggtcctgaggactctgccctcttgcatagaattagtgctcttataaaagatgcccgagggagctcttttgcccctcctgccatgtgaggacacagctagaagctaccatctgtgaaccaggaagcccccctcaccagacactgaatctgctggagccaccatcttggacttcccagcctccagagctgtgagaaataaatgcctgttgtttaagcta

SEQ ID NO: 369316 - DNA, 2218 bp, Homo sapiens
  misc_feature (40)..(40): n is a, c, g, or t
  misc_feature (58)..(58): n is a, c, g, or t
gaaaaaaaaaaaaagagaaaaggaaaacaggaaacaatangctagtgcgaggccgggnggtaagggcggctcaccagccgagaggatagagcggtgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggccccgcctgcctctgagtggtcaggccaagtctgcagggcaaagcccatgggatccctttgggtggggacctgatggctgtgggacgtgcttgggcctggagtcagtgtgggggttaacagagagagagatttgatgctaacgtcccctcaagagtgagggtcatatgagctcttcagcaggcagatgtgggtagcagggccagcctgtgtcaggggcagcccaccaagttaactcactgagtggaagccgccagtgtgccaacgcggaggggacaggccacacccagtgctcagcagctgattcctcatgtaagtggcatcatgtggtatttgttttgtgtctggcttatttctattaacataatgttctccaggttcctccatgttattgcaaatgataggatttctttccttgtaaaaaataacatgccacattttcttaccaatccgtccaccaatagacacttaggtcgttttcatagtttggcagttgtggaaatgctgcagtaaacatgggagtatagctatcttttgaagataatgatttcatctcttttttatatgtatacccagaagtgggattgctgcatcaaatggtggttctatttttaattttttgaggaaccgccatactgttttccataaaggctgtactaatttccattctcaccaacagttcactagggttcccttttctccacattgttgccaacattctttatcttgtgttttttaataacagctatcctaacaggtatgaggtgatctctctcattgcggttttgatttgcatttccctaacggttggtgatactgagcatttttgcatacaccgggtcatttgttctttgttgttgacttgagtcccttatatagtttggatactgctgtggcctgaatgtttgtgtcccccaaaaattcgtatattgaactctcatccctaaggtcaacagtttagggaagcgattaggtcctgaggactctgccctcttgcatagaattagtgctcttataaaagatgcccgagggagctcttttgcccctcctgccatgtgaggacacagctagaagctaccatctgtgaaccaggaagcccccctcaccagacactgaatctgctggagccaccatcttggacttcccagcctccagagctgtgagaaataaatgcctgttgtttaagcta

SEQ ID NO: 369317 - DNA, 2983 bp, Homo sapiens
tttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatggtaggagaatgagctcctgtttcggagctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggtactggtgagcagggagtgagggagagacacccaggacacacagccccagtcctgactgtacactgccatccacgcccaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggccccgcctgcctctgagtggtcaggccaagtctgcagggcaaagcccatgggatccctttgggtggggacctgatggctgtgggacgtgcttgggcctggagtcagtgtgggggttaacagagagagagatttgatgctaacgtcccctcaagagtgagggtcatatgagctcttcagcaggcagatgtgggtagcagggccagcctgtgtcaggggcagcccaccaagttaactcactgagtggaagccgccagtgtgccaacgcggaggggacaggccacacccagtgctcagcagctgattcctcatgtaagtggcatcatgtggtatttgttttgtgtctggcttatttctattaacataatgttctccaggttcctccatgttattgcaaatgataggatttctttccttgtaaaaaataacatgccacattttcttaccaatccgtccaccaatagacacttaggtcgttttcatagtttggcagttgtggaaatgctgcagtaaacatgggagtatagctatcttttgaagataatgatttcatctcttttttatatgtatacccagaagtgggattgctgcatcaaatggtggttctatttttaattttttgaggaaccgccatactgttttccataaaggctgtactaatttccattctcaccaacagttcactagggttcccttttctccacattgttgccaacattctttatcttgtgttttttaataacagctatcctaacaggtatgaggtgatctctctcattgcggttttgatttgcatttccctaacggttggtgatactgagcatttttgcatacaccgggtcatttgttctttgttgttgacttgagtcccttatatagtttggatactgctgtggcctgaatgtttgtgtcccccaaaaattcgtatattgaactctcatccctaaggtcaacagtttagggaagcgattaggtcctgaggactctgccctcttgcatagaattagtgctcttataaaagatgcccgagggagctcttttgcccctcctgccatgtgaggacacagctagaagctaccatctgtgaaccaggaagcccccctcaccagacactgaatctgctggagccaccatcttggacttcccagcctccagagctgtgagaaataaatgcctgttgtttaagcta

SEQ ID NO: 369318 - DNA, 1697 bp, Homo sapiens
ggccttcaggctggggctgcgggccaggccaggcatttgccactctgtttccctctctttccttgtgccccaggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggccccgcctgcctctgagtggtcaggccaagtctgcagggcaaagcccatgggatccctttgggtggggacctgatggctgtgggacgtgcttgggcctggagtcagtgtgggggttaacagagagagagatttgatgctaacgtcccctcaagagtgagggtcatatgagctcttcagcaggcagatgtgggtagcagggccagcctgtgtcaggggcagcccaccaagttaactcactgagtggaagccgccagtgtgccaacgcggaggggacaggccacacccagtgctcagcagctgattcctcatgtaagtggcatcatgtggtatttgttttgtgtctggcttatttctattaacataatgttctccaggttcctccatgttattgcaaatgataggatttctttccttgtaaaaaataacatgccacattttcttaccaatccgtccaccaatagacacttaggtcgttttcatagtttggcagttgtggaaatgctgcagtaaacatgggagtatagctatcttttgaagataatgatttcatctcttttttatatgtatacccagaagtgggattgctgcatcaaatggtggttctatttttaattttttgaggaaccgccatactgttttccataaaggctgtactaatttccattctcaccaacagttcactagggttcccttttctccacattgttgccaacattctttatcttgtgttttttaataacagctatcctaacaggtatgaggtgatctctctcattgcggttttgatttgcatttccctaacggttggtgatactgagcatttttgcatacaccgggtcatttgttctttgttgttgacttgagtcccttatatagtttggatactgctgtggcctgaatgtttgtgtcccccaaaaattcgtatattgaactctcatccctaaggtcaacagtttagggaagcgattaggtcctgaggactctgccctcttgcatagaattagtgctcttataaaagatgcccgagggagctcttttgcccctcctgccatgtgaggacacagctagaagctaccatctgtgaaccaggaagcccccctcaccagacactgaatctgctggagccaccatcttggacttcccagcctccagagctgtgagaaataaatgcctgttgtttaagcta

SEQ ID NO: 369319 - DNA, 1404 bp, Homo sapiens
tttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatgctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccgcaccatgtgtataagaagacagaccattgcaacacggtcattgcaacacggtctctca

SEQ ID NO: 369320 - DNA, 1381 bp, Homo sapiens
tttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatggtaggagaatgagctcctgtttcggagctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggtactggtgagcagggagtgagggagagacacccaggacacacagccccagtcctgactgtacactgccatccacgcccaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccctcataaccgggttttctccggctgggcagcggttccgacatcccggatacattccgggcaga

SEQ ID NO: 369321 - DNA, 1689 bp, Homo sapiens
tttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatgctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggc

SEQ ID NO: 369322 - DNA, 3212 bp, Homo sapiens
tttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatgctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggccccgcctgcctctgagtggtcaggccaagtctgcagggcaaagcccatgggatccctttgggtggggacctgatggctgtgggacgtgcttgggcctggagtcagtgtgggggttaacagagagagagatttgatgctaacgtcccctcaagagtgagggtcatatgagctcttcagcaggcagatgtgggtagcagggccagcctgtgtcaggggcagcccaccaagttaactcactgagtggaagccgccagtgtgccaacgcggaggggacaggccacacccagtgctcagcagctgattcctcatgtaagtggcatcatgtggtatttgttttgtgtctggcttatttctattaacataatgttctccaggttcctccatgttattgcaaatgataggatttctttccttgtaaaaaataacatgccacattttcttaccaatccgtccaccaatagacacttaggtcgttttcatagtttggcagttgtggaaatgctgcagtaaacatgggagtatagctatcttttgaagataatgatttcatctcttttttatatgtatacccagaagtgggattgctgcatcaaatggtggttctatttttaattttttgaggaaccgccatactgttttccataaaggctgtactaatttccattctcaccaacagttcactagggttcccttttctccacattgttgccaacattctttatcttgtgttttttaataacagctatcctaacaggtatgaggtgatctctctcattgcggttttgatttgcatttccctaacggttggtgatactgagcatttttgcatacaccgggtcatttgttctttgttgttgacttgagtcccttatatagtttggatactgctgtggcctgaatgtttgtgtcccccaaaaattcgtatattgaactctcatccctaaggtcaacagtttagggaagcgattaggtcctgaggactctgccctcttgcatagaattagtgctcttataaaagatgcccgagggagctcttttgcccctcctgccatgtgaggacacagctagaagctaccatctgtgaaccaggaagcccccctcaccagacactgaatctgctggagccaccatcttggacttcccagcctccagagctgtgagaaataaatgcctgttgtttaagctacccagtctgtggtattttgttagaacagcccaagttgagacagatagtaaccctttaccagatacatggtttgcaaatagtttttcccactctgtagatatagccattgagaagctcctcaagatagacattaaatacaaagaagcatggtgtgaaacgccatgtgtgatatgctgtcagtgtgcaaaagaggcagggagggccctgcacttgcatgtatgtgctgcatcatccccagaaggctgaactccttgctggtgcactgggtacccagggaggagggaggttctttactgtaatgttagcaggtgaacattgtatccacttgaccacgaag

SEQ ID NO: 369323 - DNA, 1735 bp, Homo sapiens
tttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatgctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggcaaaaaaaaaaacacaaaaaagcacacacaacaacaaaaaacgaggg

SEQ ID NO: 369324 - DNA, 2092 bp, Homo sapiens
  misc_feature (2092)..(2092): n is a, c, g, or t
tttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatgctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggcaaaaaaaacaaagaaaaaaagcgggggccaccaaaatccccgagaggccacgttaagcgaaccaatttttacaagcgggcccatacggagcacatataacacacaacgcccgcgatataaaagcacggaggggggaacaacgtgaaccgggaaacgggagaagacacaaatctgggaggggcaacagaggaaaaacccttcacggaggtacagcacaggaaaacacaaaacaacggaagcatggtgaacgagccactatgacggaaaagtaagcatatgataaaaaacgagaagacgagagcgcagcagagagaggagcacacgacaagacaacaacaacatcagagacagaggaaggacaacagatagctagcaaagcatcgcactcccgcacctgctgctn

SEQ ID NO: 369325 - DNA, 3027 bp, Homo sapiens
tttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatggtaggagaatgagctcctgtttcggagaggtccggggcgcgtgaagtgctggggatgtggctctggggacttggaggctcagcggctccggggctccggggttccggggctcgggagcgagtagtgagtgactgggcctgctgttcccacagctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggccccgcctgcctctgagtggtcaggccaagtctgcagggcaaagcccatgggatccctttgggtggggacctgatggctgtgggacgtgcttgggcctggagtcagtgtgggggttaacagagagagagatttgatgctaacgtcccctcaagagtgagggtcatatgagctcttcagcaggcagatgtgggtagcagggccagcctgtgtcaggggcagcccaccaagttaactcactgagtggaagccgccagtgtgccaacgcggaggggacaggccacacccagtgctcagcagctgattcctcatgtaagtggcatcatgtggtatttgttttgtgtctggcttatttctattaacataatgttctccaggttcctccatgttattgcaaatgataggatttctttccttgtaaaaaataacatgccacattttcttaccaatccgtccaccaatagacacttaggtcgttttcatagtttggcagttgtggaaatgctgcagtaaacatgggagtatagctatcttttgaagataatgatttcatctcttttttatatgtatacccagaagtgggattgctgcatcaaatggtggttctatttttaattttttgaggaaccgccatactgttttccataaaggctgtactaatttccattctcaccaacagttcactagggttcccttttctccacattgttgccaacattctttatcttgtgttttttaataacagctatcctaacaggtatgaggtgatctctctcattgcggttttgatttgcatttccctaacggttggtgatactgagcatttttgcatacaccgggtcatttgttctttgttgttgacttgagtcccttatatagtttggatactgctgtggcctgaatgtttgtgtcccccaaaaattcgtatattgaactctcatccctaaggtcaacagtttagggaagcgattaggtcctgaggactctgccctcttgcatagaattagtgctcttataaaagatgcccgagggagctcttttgcccctcctgccatgtgaggacacagctagaagctaccatctgtgaaccaggaagcccccctcaccagacactgaatctgctggagccaccatcttggacttcccagcctccagagctgtgagaaataaatgcctgttgtttaagcta

SEQ ID NO: 369326 - DNA, 2966 bp, Homo sapiens
tttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatgctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggtgggtccacgggccatgccccaggaaaggcatcccccccctgtgtacctcgtgctgcttgccgttgacccacagctgttccctcccaggcgcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggccccgcctgcctctgagtggtcaggccaagtctgcagggcaaagcccatgggatccctttgggtggggacctgatggctgtgggacgtgcttgggcctggagtcagtgtgggggttaacagagagagagatttgatgctaacgtcccctcaagagtgagggtcatatgagctcttcagcaggcagatgtgggtagcagggccagcctgtgtcaggggcagcccaccaagttaactcactgagtggaagccgccagtgtgccaacgcggaggggacaggccacacccagtgctcagcagctgattcctcatgtaagtggcatcatgtggtatttgttttgtgtctggcttatttctattaacataatgttctccaggttcctccatgttattgcaaatgataggatttctttccttgtaaaaaataacatgccacattttcttaccaatccgtccaccaatagacacttaggtcgttttcatagtttggcagttgtggaaatgctgcagtaaacatgggagtatagctatcttttgaagataatgatttcatctcttttttatatgtatacccagaagtgggattgctgcatcaaatggtggttctatttttaattttttgaggaaccgccatactgttttccataaaggctgtactaatttccattctcaccaacagttcactagggttcccttttctccacattgttgccaacattctttatcttgtgttttttaataacagctatcctaacaggtatgaggtgatctctctcattgcggttttgatttgcatttccctaacggttggtgatactgagcatttttgcatacaccgggtcatttgttctttgttgttgacttgagtcccttatatagtttggatactgctgtggcctgaatgtttgtgtcccccaaaaattcgtatattgaactctcatccctaaggtcaacagtttagggaagcgattaggtcctgaggactctgccctcttgcatagaattagtgctcttataaaagatgcccgagggagctcttttgcccctcctgccatgtgaggacacagctagaagctaccatctgtgaaccaggaagcccccctcaccagacactgaatctgctggagccaccatcttggacttcccagcctccagagctgtgagaaataaatgcctgttgtttaagcta

SEQ ID NO: 369327 - DNA, 2184 bp, Homo sapiens
tttccaaatgcttgccggccgttttccttgcccattgggttctcctgttggttttgagagtgtttcttccgtgtgatgaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggccccgcctgcctctgagtggtcaggccaagtctgcagggcaaagcccatgggatccctttgggtggggacctgatggctgtgggacgtgcttgggcctggagtcagtgtgggggttaacagagagagagatttgatgctaacgtcccctcaagagtgagggtcatatgagctcttcagcaggcagatgtgggtagcagggccagcctgtgtcaggggcagcccaccaagttaactcactgagtggaagccgccagtgtgccaacgcggaggggacaggccacacccagtgctcagcagctgattcctcatgtaagtggcatcatgtggtatttgttttgtgtctggcttatttctattaacataatgttctccaggttcctccatgttattgcaaatgataggatttctttccttgtaaaaaataacatgccacattttcttaccaatccgtccaccaatagacacttaggtcgttttcatagtttggcagttgtggaaatgctgcagtaaacatgggagtatagctatcttttgaagataatgatttcatctcttttttatatgtatacccagaagtgggattgctgcatcaaatggtggttctatttttaattttttgaggaaccgccatactgttttccataaaggctgtactaatttccattctcaccaacagttcactagggttcccttttctccacattgttgccaacattctttatcttgtgttttttaataacagctatcctaacaggtatgaggtgatctctctcattgcggttttgatttgcatttccctaacggttggtgatactgagcatttttgcatacaccgggtcatttgttctttgttgttgacttgagtcccttatatagtttggatactgctgtggcctgaatgtttgtgtcccccaaaaattcgtatattgaactctcatccctaaggtcaacagtttagggaagcgattaggtcctgaggactctgccctcttgcatagaattagtgctcttataaaagatgcccgagggagctcttttgcccctcctgccatgtgaggacacagctagaagctaccatctgtgaaccaggaagcccccctcaccagacactgaatctgctggagccaccatcttggacttcccagcctccagagctgtgagaaataaatgcctgttgtttaagcta

SEQ ID NO: 369328 - DNA, 3118 bp, Homo sapiens
tttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatggtaggagaatgagctcctgtttcggagaggtccggggcgcgtgaagtgctggggatgtggctctggggacttggaggctcagcggctccggggctccggggttccggggctcgggagcgagtagtgagtgactgggcctgctgttcccacagctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggtgggtccacgggccatgccccaggaaaggcatcccccccctgtgtacctcgtgctgcttgccgttgacccacagctgttccctcccaggcgcaccatgtgtataagaagacagaccaccgcaacgtggagctcactgaggtcgggccccgctttgagctgaagctgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggccccgcctgcctctgagtggtcaggccaagtctgcagggcaaagcccatgggatccctttgggtggggacctgatggctgtgggacgtgcttgggcctggagtcagtgtgggggttaacagagagagagatttgatgctaacgtcccctcaagagtgagggtcatatgagctcttcagcaggcagatgtgggtagcagggccagcctgtgtcaggggcagcccaccaagttaactcactgagtggaagccgccagtgtgccaacgcggaggggacaggccacacccagtgctcagcagctgattcctcatgtaagtggcatcatgtggtatttgttttgtgtctggcttatttctattaacataatgttctccaggttcctccatgttattgcaaatgataggatttctttccttgtaaaaaataacatgccacattttcttaccaatccgtccaccaatagacacttaggtcgttttcatagtttggcagttgtggaaatgctgcagtaaacatgggagtatagctatcttttgaagataatgatttcatctcttttttatatgtatacccagaagtgggattgctgcatcaaatggtggttctatttttaattttttgaggaaccgccatactgttttccataaaggctgtactaatttccattctcaccaacagttcactagggttcccttttctccacattgttgccaacattctttatcttgtgttttttaataacagctatcctaacaggtatgaggtgatctctctcattgcggttttgatttgcatttccctaacggttggtgatactgagcatttttgcatacaccgggtcatttgttctttgttgttgacttgagtcccttatatagtttggatactgctgtggcctgaatgtttgtgtcccccaaaaattcgtatattgaactctcatccctaaggtcaacagtttagggaagcgattaggtcctgaggactctgccctcttgcatagaattagtgctcttataaaagatgcccgagggagctcttttgcccctcctgccatgtgaggacacagctagaagctaccatctgtgaaccaggaagcccccctcaccagacactgaatctgctggagccaccatcttggacttcccagcctccagagctgtgagaaataaatgcctgttgtttaagcta

SEQ ID NO: 369329 - DNA, 1755 bp, Homo sapiens
tttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatgctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcaccttcgcaaaccaggacgactacatatcattccggtgggtccacgggccatgccccaggaaaggcatcccccccctgtgtacctcgtgctgcttgccgttgacccacagctgttccctcccaggcgcaccatgtgtataagaagacagaccaccgcaacgtggagctcactgagtgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggc

SEQ ID NO: 369330 - DNA, 1494 bp, Homo sapiens
tttaagggcaagcgcccttagagaagcagcacggaagcaaccaatcaactggtttctccaattagcccccaagtggatcagcctgctgaactgtcggctagggttataggtggttctgagtccttccggaagctgccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatgctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggagtcgaggatcccaaggttatgatcactacctcccgagaccccagttcccgcctcaagatgtttgcaaaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctgtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtctctgacatcctccgatacctatttcccgtgcccaaagatgacagccaccgggtcatcacgagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggc

SEQ ID NO: 369331 - DNA, 365 bp, Homo sapiens
agatggagtcttgctctgtcgtccaggcgggagtgcagtggcgtgatctcagcttactgcaacctctgcctctcgggtccagtcctcccacctcagcctcctgagtagctgggattacaggtgtgtgccatcaagcccggctaatttttgtatttttagtagagatggggtttcactatgttggatggctgatctcgatctcctgacctcaggtgatccgcccaccttggcctcccaaagtgctgggattacaggcatgagccactgtgcccggcctgtttccttgaattggatcaaaatatgatctatacattacaatcaggtaatgtttcttacctgatttttgtttgtttgtttgtttttaa

SEQ ID NO: 369332 - DNA, 437 bp, Homo sapiens
tttggagttttaaaatcttcttctaccacgaactctacccctgacaaacggtgagaaaataaatagaattgctagtcttcatcacacggaaaagagctagtgagctatttcgtttcctccctttttctgcccccttctcttttcccagcttcccatttatagccctgctttgcagagacagcaacagatactctagaagcaggatgaacatgagagtggatttacaacatggaaagcaaaggccatgcattcctaaagggcagggaaggccttaagggcagggctttgacttttcaccactgcctcctctgcctagcacctgcatgcagtgggcattcaactaatatttaaggcagaacaggaaggaaaggcaaaaacttgggaagaaatatacaactgaggagaaaatttccagacatttcactgtgaaggtgtca

SEQ ID NO: 369333 - DNA, 141 bp, Homo sapiens
tgaagatattcaaatggttcctcctacaacaaaggaagccctatatgaaaatttaaagttctatttgaattgaaatgaaaaagtgtgtcctgtctcttatgtagtggtatggctatatcagcataagtaggcaccttatcc

SEQ ID NO: 369334 - DNA, 2892 bp, Homo sapiens
attcggcacgatggggttgtccacagtctcgtagctaccaagtgacaggccacgatttgatctcaggccagtgtgttaaactccaatttgcgtgctcctgtccctccccgcgcgtcggcggagctcggggccggactggacctgccgagggaggggcggacagtcctgacggtgcggggcggggctggcggctgcccaggcctggctgaggcgccgcggccgggtccctctccacctgccgggcggagcgcacgggccatgggctgagccccgctgagcccgccgggccggccatgggcgatcgcgagcgcaacaagaagcggctgctggagctgctgcgggcgccggacacaggcaacgcgcactgcgccgactgcggggcggcagatcccgactgggcctcttacaagctggggatcttcatctgtctcaactgctgcggcgtccaccgtaacttccctgacatcagcagagttaaatctgtgcgacttgacttctgggacgacagtattgtggagtttatgatccacaatggaaacctccgtgtgaaggccaagttcgaagccagagtcccagctttctactacatcccccaggccaacgactgcctggtcttaaaggaacaatggattcgagctaagtatgagagacgggaatttatggctgatggggaaaccatctcgctcccaggtaaccgagaaggattcctgtggaagcgaggaagggacaactcacagtttctgagaaggaagtttgtacttctggcaagagaaggcctcctgaagtacttcacaaaggaacagggtaaaagccccaaagctgtcatcagcattaaggacttgaatgccaccttccagacagagaagatagggcacccccatgggctgcagatcacctacaggagagatggccacaccaggaacctgtttgtgtatcatgaaagtgggaaggagatagtggactggttcaatgccctccgtgcagcccgtctgcagtacctaaaaatggcctttcctgaactcccagagtctgagctcgtgccattcctcaccaggaactacctcaaacaaggcttcatggaaaagactgggccaaagcagaaagaacctttcaagaaaaggtggttcgccctggattgccatgagcggaggctgctctattacaagaacccactggatgccttcgagcagggccaggtttttcttgggaacaaggagcagggatatgaagcctacgaagacctgcccaagggcatccgaggaaatcgctggaaagccggactcaccattgtcaccccagagcggagatttgtcctcacttgccccagtgagaaggaacagcaggaatggctggaaagtttgcggggtgtcctgtccagccccttgacgcccctcaaccggcttactgcatcaacagagagtggccgcagcagcaggtgacccattaactgaggaactggctgccactgaacacctggaactccttgtgggaagaagtttgcacctcggccctggctgcccaccatcagtgccccgcagtcagcagccattcctggcagtgaactctgccaggactgaagctgtggctttatccatcagctccctgggccttccccgcaacccacctcggggatctgaggatctggtgcatagatgaacatctatcccctcctcccccatacacacctaggcttgaaatgccctacaggcccagaactttctcacatctgaaatggaggcattgcaatgaaaaggcacccacagcatcatgcaagtggcatcttgtaaaaaaaaaaaaaaagtttaatctgaatctaaccatgaggaaataatcagacaaatccacattaggggcattctgctaaacatctgacccagactcttcaaaaatgaagagtgaaagataaagtagtcaatggccgggcgcagtgagattgcgccattgcattccagcctgggtgacagagcgagactccgtatcagaaagaaaaagaggaactgaatgaaatctcagatggctgaaatgttagagaaacagagcaccaagtcccctgctctgtgactcgttgttcctttcctctgtcttcaagcaccacgcagaaatacactggatgttctctctttgcttcaatggagacccaaggagctgggaggtctcttaagagactctctgattctccgtggctgggtgtgatggctcatgcccataatcccagccctttgggaagctgaggcaggaggattgagaccaggagttcgagaagagcctgggcaacatagtgagaccccatctctacaaagaaaaaaaaattagctggacatggtaatgaatgcctgtagtcccagctactccggacactgatgtgagaggatcacttgagccagggaggtcatggctacagtgacccctcattgcaccactttacttagcctgggtgacagagtgagaccctatctcaaaaaaaaaaaaaatctatgcattgtatgggactttcctttggatcccccaatcaaaggataagcaatgcgtaagcctgtgtccttcctgaagcttctcgactgcccagatagggaggtgagtcctctctatctcctctggctctggaagcaccttgaaaatgtgcattttcaaggacacttgctgggttgtgcattaagggccagtttacttgtctgcctctttgaccacctgtgaactctgttgggtgtactctgctaagttctggggatgaggaaattaataaaggtacagtcttgccttcaaggaacttatggtctagaggagaagaacgagaagtatagataggcagtaacaaagctacttgaagaggccaactgggattctaagggtgggaaagaacagacacaagagataaagtcctaatgaaatgga

SEQ ID NO: 369335 - DNA, 2037 bp, Homo sapiens
aggcagcagggtgaagctggcaaagggtatggtggggttggaaggggaatgggcagaaccttcagagcctgagggctcctatccaggccccagggagaagcactaggatgtctgactgaggaggctgggctggagaaccagtgggactggccagctcctttggtttgggctgggctggcccctgacctctatcctcagaaactgacctggtcatctgtggtaagaagttccctcttttgcagcagaaagaacctttcaagaaaaggtggttcgccctggattgccatgagcggaggctgctctattacaagaacccactggatgccttcgagcagggccaggtttttcttgggaacaaggagcagggatatgaagcctacgaagacctgcccaagggcatccgaggaaatcgctggaaagccggactcaccattgtcaccccagagcggagatttgtcctcacttgccccagtgagaaggaacagcaggaatggctggaaagtttgcggggtgtcctgtccagccccttgacgcccctcaaccggcttactgcatcaacagagagtggccgcagcagcaggtgacccattaactgaggaactggctgccactgaacacctggaactccttgtgggaagaagtttgcacctcggccctggctgcccaccatcagtgccccgcagtcagcagccattcctggcagtgaactctgccaggactgaagctgtggctttatccatcagctccctgggccttccccgcaacccacctcggggatctgaggatctggtgcatagatgaacatctatcccctcctcccccatacacacctaggcttgaaatgccctacaggcccagaactttctcacatctgaaatggaggcattgcaatgaaaaggcacccacagcatcatgcaagtggcatcttgtaaaaaaaaaaaaaaagtttaatctgaatctaaccatgaggaaataatcagacaaatccacattaggggcattctgctaaacatctgacccagactcttcaaaaatgaagagtgaaagataaagtagtcaatggccgggcgcagtgagattgcgccattgcattccagcctgggtgacagagcgagactccgtatcagaaagaaaaagaggaactgaatgaaatctcagatggctgaaatgttagagaaacagagcaccaagtcccctgctctgtgactcgttgttcctttcctctgtcttcaagcaccacgcagaaatacactggatgttctctctttgcttcaatggagacccaaggagctgggaggtctcttaagagactctctgattctccgtggctgggtgtgatggctcatgcccataatcccagccctttgggaagctgaggcaggaggattgagaccaggagttcgagaagagcctgggcaacatagtgagaccccatctctacaaagaaaaaaaaattagctggacatggtaatgaatgcctgtagtcccagctactccggacactgatgtgagaggatcacttgagccagggaggtcatggctacagtgacccctcattgcaccactttacttagcctgggtgacagagtgagaccctatctcaaaaaaaaaaaaaatctatgcattgtatgggactttcctttggatcccccaatcaaaggataagcaatgcgtaagcctgtgtccttcctgaagcttctcgactgcccagatagggaggtgagtcctctctatctcctctggctctggaagcaccttgaaaatgtgcattttcaaggacacttgctgggttgtgcattaagggccagtttacttgtctgcctctttgaccacctgtgaactctgttgggtgtactctgctaagttctggggatgaggaaattaataaaggtacagtcttgccttcaaggaacttatggtctagaggagaagaacgagaagtatagataggcagtaacaaagctacttgaagaggccaactgggattctaagggtgggaaagaacagacacaagagataaagtcctaatgaaatgga

SEQ ID NO: 369336 - DNA, 808 bp, Homo sapiens
aggcagcagggtgaagctggcaaagggtatggtggggttggaaggggaatgggcagaaccttcagagcctgagggctcctatccaggccccagggagaagcactaggatgtctgactgaggaggctgggctggagaaccagtgggactggccagctcctttggtttgggctgggctggcccctgacctctatcctcagaaactgacctggtcatctgtggtaagaagttccctcttttgcagcagaaagaacctttcaagaaaaggtggttcgccctggattgccatgagcggaggctgctctattacaagaacccactggatgccttcgagcagggccaggtttttcttgggaacaaggagcagggatatgaagcctacgaagacctgcccaagggcatccgaggaaatcgctggaaagccggactcaccattgtcaccccagagcggagatttgtcctcacttgccccagtgagaaggaacagcaggaatggctggaaagtttgcggggtgtcctgtccagccccttgacgcccctcaaccggcttagtaagaagcaggaactgaggggtgttcttttggacaagggcagaggacagaaaattgcttcttcacttaggttcagctttgataccacaaaagattcctgattcctgactatgctcttttcattgtcttctcttcctgcaaaagaaaagcacagacatgccattattgccaaaaggtctcctctgtccactctgggttcccctaaccgagcccttccccaggagcttttagaggagtttggccctggcagaacccctgg

SEQ ID NO: 369337 - DNA, 356 bp, Homo sapiens
  misc_feature (344)..(344): n is a, c, g, or t
  misc_feature (347)..(348): n is a, c, g, or t
tccacaggacagcattggcatggccacctccctcagccctcttcatttcccttgcagctgcatcaacagagagtggccgcagcagcaggtgacccattaactgaggaactggctgccactgaacacctggaactccttgtgggaagaagtttgcacctcggccctggctgcccaccatcagtgccccgcagtcagcagccattcctggcagtgaactctgccaggactgaagctgtggctttatccatcagctccctgggccttccccgcaacccacctcggggatctgaggatctggtgcatagatgaacatctatcccctcctcccccatccttgtcgggtnccnngcgggttt

SEQ ID NO: 369338 - DNA, 349 bp, Homo sapiens
tcctctcagaactggttagaccaaatggctttgtcaaaatctggacaacagtcgcactttaagaggatcttggcggccaggtccagtcgctcatgcctatactcccagcaatttgggaggcccgtaatcccagtactttgggagggcagatcacaaggtcaggagatcgagaccgtcctgtctaacacggtgaaaccccgtctctactgaaaatacaaaaagttagccgggcgtgatggcgggtgcctgtagtcccagctacttgggaggctgaggcaggagaatggcatgaacctgggaggcggagcttgcagtgagccgagatcgtgccactgcactccagccttgg

SEQ ID NO: 369339 - DNA, 468 bp, Homo sapiens
  misc_feature (214)..(214): n is a, c, g, or t
gatgccaggatgatggaggaggccctcgacggggctccctccctccctccacaccaccaccaccaccaccaccaccgccgtggctgcctctgaagaggacgaggagtgtggctgagagcccagaaaggggcacttcacatctcccgaggccatcagagtcagcctctctggcccaagcagctgcctctgtttgctcaggtaagattgagagccntctcttacgactatttcaccaggagttgggggtgggggctggaggctgttgagtccctgtcgaaaccacagaggttattgagaggaaagctcatccatgaagaccccaacgtgccttcaaaacttgtgtttgcttaagcagcccagacggccaatgcttcatgtagagagcaatgtggtgtttgcaaaacatcgactctgcctcttcctgtgggccgacctccccgcgtgttccaccgggaggcgattcttgcg

SEQ ID NO: 369340 - DNA, 385 bp, Homo sapiens
agaactgttgggaggcataaatgaccctcagcacagggtggtgtgtatggaatgtgcatcataagtggcagctattttgataattactaaacatgatgaatgatgataagcgaaataataacacagcttttcaacattttcactcaataagttaaatttataataggcaagcaaaggagtttccagaattaagcatctgatgggagcttagacaggttgacttttacagctcattctaaccctgagtgagggtctgtgattttataagcccttttagggttcgagtgctacttctaatcaagatcctggtatcatgtttttctccattacgtggaacaataatgaatagataaataaaatataactgggaaaggagaacacagat

SEQ ID NO: 369341 - DNA, 535 bp, Homo sapiens
cgtatttccggagtcccttctgagacagaaggttgtgttggggaactgaagcagtttctgtgggcggacagggaaccctgcgtttctactgtgtgattctgccaccttcctggcccgacgccatgggagtgacttgtgtgtcccagatgcctgtggccgagggcaagagtgttcagcaaaccgtagagctccttacccggaaattggagatgcttggggcagagaagcaaggaacattttgtgtggactgtgagacttaccatacggccgcctctacccttggcagccaaggtaatagagaagaggaaacctaaccaatgactgtggaataatatggaagaagatggaaaaaacttgtttaatgggttgagaaagtggcgacttctataagacatggatagatgcaaacatgtagggcggttacggctcgcccaggaccactccatcctgaaccctcagaagtggtgctgcttagagtgtgccaccaccgagtccgtgtgggcctgcctcaagtgctcccacgtggcctgcggcc

SEQ ID NO: 369342 - DNA, 3158 bp, Homo sapiens
cgtatttccggagtcccttctgagacagaaggttgtgttggggaactgaagcagtttctgtgggcggacagggaaccctgcgtttctactgtgtgattctgccaccttcctggcccgacgccatgggagtgacttgtgtgtcccagatgcctgtggccgagggcaagagtgttcagcaaaccgtagagctccttacccggaaattggagatgcttggggcagagaagcaaggaacattttgtgtggactgtgagacttaccatacggccgcctctacccttggcagccaaggtcagaccgggaagctgatgtatgtgatgcacaactcagagtacccattgagctgtttcgccctctttgagaatggcccttgccttattgctgacaccaactttgatgtgcttatggtgaagctcaagggctttttccagagtgctaaggccagcaagattgagacccggggcaccaggtaccagtactgtgacttcctggtgaaggtgggcacggtcacaatggggcccagtgcccggggcatctctgtggaggtggagtatggcccctgtgtggtagctagtgactgctggagtctgctgctcgagttcctacagagttttctaggcagccacacaccaggggctcccgcagtgtttgggaacagacatgatgcggtctacggcccagcagataccatggtccagtacatggaactcttcaacaagatccgcaagcagcagcaggtgccggtggctgggattcgttagtgatgagcagctgccagctgagctctgtcaccaggggtactccacaggaggagcaggtgctgactttcaggtccctggaccccagaaacccagggtagacatggactctactctccttctctggttctcagctgtggcttttgttctggggctgagtcccctccccaaccccctgactctcacacatagccccccatcagctgttttactccgtgccttactggatttggcctgtcctcaagaatggtaattatgaagagtggagaagtttggaccttgcctcctttaggggaaaggtaggacaggaatgtccctgcctggtactggtgggggaaatagtccgtatccccaactattaaggatttgtcccaggccaatggtgaacatgctgcattttatgtttggattgtgctgtaataagagcctcttccttccctcagaggatgtggctgggcttctatcctagagatggagtagaaggcacaactggtttgatagttactattttctgacctgtttgctgaagtgatttgcgaattgactttcctagggtgttgcctgagtcctttgaaatctccttctgacatctttcccttctgttgtgaaatatgttaagccacaggccaaactgctataagatcgaagtttgtttttttctcacctaataatagagaggtaatcagatggtctagggcagatttaactctacaaggttatcaggaactttgtttccttctgtcttattcagccattcccagtatgttttcttacccataagatcaaagcagactcatcagctccatatctgcattccactggggaaagagagagagaaaagagcagatttttaaaaaaagatatgactgagcattgctcagatcactgtggccacactttgctgaaagagatgctgggacatagaacctcttatctgggcagtcatgtgctgagttaaaactcagggattctgtgactacaagatgaaagacaatttggttgctgagatgcagttaatggcttctgttacatggagctcaatggacgtgcccaggaatgcttttggctgttattttgcagttaatacctcctgtaactaaagcatttgtttatgagttgacttgagagaagggctgatctcagagccgctttgagctaagttggattagtcacactaggaagttaattccacacctttcgtctaagtctcagtattgaggcctctccagttctcatgcaccctgatcttagggttagaatacttgaccctgatacctgcaccatgcttcatggttcctgagctctttctcctgtttcatttgagcctccaaactacatatttggtcatattgcctgcctaccccatgcctgctgcagaaatattcatccaggttaaccttgatatacacagagatggtcttggagaattgtgaatgtatgtactgtattgtcatcaaggatactgtcccttatttgaaggcatctaaagagaaactgttttcagatccaagtgctcagatctaaagcctctgcaacaagtcaggtggtggtcatgtttcccttctagttttggctgacaggaagctcagttcagtaccataactacagaacctgtcatctgtattttttgttctcaccccgtttttgttattttgtttctggttttttatattgaggtatgttttagatatagtttacaaaaataaaacgcacagatcttaaaaaaaaaaaaacaaaaacaacaaaaaaaacaaaaaaaaaaaaaaaaaaaaaaaaaaaaacaaaaacacacaaacacaacacaaaaaaataaaccaccagacacacacaagaagcaaaaaaaaaagaaaacaaaaacgcagagaagacggcgagggggcgcgcgacataccgaccgaccacaggaggagtccaaacagcagcgagacacgccgagatcgcccttccacgcaaggaggggagcgcggacagagggacgccgcctgactacctgccgccccgcgcgccaccgcggcgtctgtgtacgcggcggagccggagcagacaaaaagactagcgatagtctaggggactagagttatgggtcaggctgaaggtgcctgcatcattggtctgtagggtggtgcatgtcatcacagtcataaggtacacataccatactcctaggaaaggtgcttatgtacgcgttatgttggtggcacagtctatatagaagtcgtcgactggtagtctagactactggttgcgttcaggttctaaacaacctatcacgtttatcaggtgatgctcgtagtctaagaatgatagagagcggattcggtgaatgtcatgttgcttagtcgtaaaactctattatatacggacggaggagagatgataaaagaaagaggaaggggaagg

SEQ ID NO: 369343 - DNA, 2225 bp, Homo sapiens
cgtatttccggagtcccttctgagacagaaggttgtgttggggaactgaagcagtttctgtgggcggacagggaaccctgcgtttctactgtgtgattctgccaccttcctggcccgacgccatgggagtgacttgtgtgtcccagatgcctgtggccgagggcaagagtgttcagcaaaccgtagagctccttacccggaaattggagatgcttggggcagagaagcaaggaacattttgtgtggactgtgagacttaccatacggccgcctctacccttggcagccaaggtggagtatggcccctgtgtggtagctagtgactgctggagtctgctgctcgagttcctacagagttttctaggcagccacacaccaggggctcccgcagtgtttgggaacagacatgatgcggtctacggcccagcagataccatggtccagtacatggaactcttcaacaagatccgcaagcagcagcaggtgccggtggctgggattcgttagtgatgagcagctgccagctgagctctgtcaccaggggtactccacaggaggagcaggtgctgactttcaggtccctggaccccagaaacccagggtagacatggactctactctccttctctggttctcagctgtggcttttgttctggggctgagtcccctccccaaccccctgactctcacacatagccccccatcagctgttttactccgtgccttactggatttggcctgtcctcaagaatggtaattatgaagagtggagaagtttggaccttgcctcctttaggggaaaggtaggacaggaatgtccctgcctggtactggtgggggaaatagtccgtatccccaactattaaggatttgtcccaggccaatggtgaacatgctgcattttatgtttggattgtgctgtaataagagcctcttccttccctcagaggatgtggctgggcttctatcctagagatggagtagaaggcacaactggtttgatagttactattttctgacctgtttgctgaagtgatttgcgaattgactttcctagggtgttgcctgagtcctttgaaatctccttctgacatctttcccttctgttgtgaaatatgttaagccacaggccaaactgctataagatcgaagtttgtttttttctcacctaataatagagaggtaatcagatggtctagggcagatttaactctacaaggttatcaggaactttgtttccttctgtcttattcagccattcccagtatgttttcttacccataagatcaaagcagactcatcagctccatatctgcattccactggggaaagagagagagaaaagagcagatttttaaaaaaagatatgactgagcattgctcagatcactgtggccacactttgctgaaagagatgctgggacatagaacctcttatctgggcagtcatgtgctgagttaaaactcagggattctgtgactacaagatgaaagacaatttggttgctgagatgcagttaatggcttctgttacatggagctcaatggacgtgcccaggaatgcttttggctgttattttgcagttaatacctcctgtaactaaagcatttgtttatgagttgacttgagagaagggctgatctcagagccgctttgagctaagttggattagtcacactaggaagttaattccacacctttcgtctaagtctcagtattgaggcctctccagttctcatgcaccctgatcttagggttagaatacttgaccctgatacctgcaccatgcttcatggttcctgagctctttctcctgtttcatttgagcctccaaactacatatttggtcatattgcctgcctaccccatgcctgctgcagaaatattcatccaggttaaccttgatatacacagagatggtcttggagaattgtgaatgtatgtactgtattgtcatcaaggatactgtcccttatttgaaggcatctaaagagaaactgttttcagatccaagtgctcagatctaaagcctctgcaacaagtcaggtggtggtcatgtttcccttctagttttggctgacaggaagctcagttcagtaccataactacagaacctgtcatctgtattttttgttctcaccccgtttttgttattttgtttctggttttttatattgaggtatgttttagatatagtttacaaaaataaaacgcacagatctta

SEQ ID NO: 369344 - DNA, 1829 bp, Homo sapiens
cgtatttccggagtcccttctgagacagaaggttgtgttggggaactgaagcagtttctgtgggcggacagggaaccctgcgtttctactgtgtgattctgccaccttcctggcccgacgccatgggagtgacttgtgtgtcccagatgcctgtggccgagggcaagagtgttcagcaaaccgtagagctccttacccggaaattggagatgcttggggcagagaagcaaggaacattttgtgtggactgtgagacttaccatacggccgcctctacccttggcagccaaggtcagaccgggaagctgatgtatgtgatgcacaactcagagtacccattgagctgtttcgccctctttgagaatggcccttgccttattgctgacaccaactttgatgtgcttatggtgaagctcaagggctttttccagagtgctaaggccagcaagattgagacccggggcaccaggtaccagtactgtgacttcctggtgaaggtgggcacggtcacaatggggcccagtgcccggggcatctctgtggaggtggagtatggcccctgtgtggtagctagtgactgctggagtctgctgctcgagttcctacagagttttctaggcagccacacaccaggggctcccgcagtgtttgggaacagacatgatgcggtctacggcccagcagataccatggtccagtacatggaactcttcaacaagatccgcaagcagcagcaggtgccggtggctgggattcgttagtgatgagcagctgccagctgagctctgtcaccaggggtactccacaggaggagcaggtgctgactttcaggtccctggaccccagaaacccagggtagacatggactctactctccttctctggttctcagctgtggcttttgttctggggctgagtcccctccccaaccccctgactctcacacatagccccccatcagctgttttactccgtgccttactggatttggcctgtcctcaagaatggtaattatgaagagtggagaagtttggaccttgcctcctttaggggaaaggtaggacaggaatgtccctgcctggtactggtgggggaaatagtccgtatccccaactattaaggatttgtcccaggccaatggtgaacatgctgcattttatgtttggattgtgctgtaataagagcctcttccttccctcagaggatgtggctgggcttctatcctagagatggagtagaaggcacaactggtttgatagttactattttctgacctgtttgctgaagtgatttgcgaattgactttcctagggtgttgcctgagtcctttgaaatctccttctgacatctttcccttctgttgtgaaatatgttaagccacaggccaaactgctataagatcgaagtttgtttttttctcacctaataatagagaggtaatcagatggtctagggcagatttaactctacaaggttatcaggaactttgtttccttctgtcttattcagccattcccagtatgttttcttacccataagatcaaagcagactcatcagctccatatctgcattccactggggaaagagagagagaaaagagcagatttttaaaaaaagatatgactgagcattgctcagatcactgtggccacactttgctgaaagagatgctgggacatagaacctcttatctgggcagtcatgtgctgagttaaaactcagggattctgtgactacaagatgaaagacaatttggttgctgtgggttgattttggcagtaataccctctggaacaaaccatttggttatttgccttggagggctgcc

SEQ ID NO: 369345 - DNA, 933 bp, Homo sapiens
cgtatttccggagtcccttctgagacagaaggttgtgttggggaactgaagcagtttctgtgggcggacagggaaccctgcgtttctactgtgtgattctgccaccttcctggcccgacgccatgggagtgacttgtgtgtcccagatgcctgtggccgagggcaagagtgttcagcaaaccgtagagctccttacccggaaattggagatgcttggggcagagaagcaaggaacattttgtgtggactgtgagacttaccatacggccgcctctacccttggcagccaaggtcagaccgggaagctgatgtatgtgatgcacaactcagagtacccattgagctgtttcgccctctttgagaatggcccttgccttattgctgacaccaactttgatgtgcttatggtgaagctcaagggctttttccagagtgctaaggccagcaagattgagacccggggcaccaggtaccagtactgtgacttcctggtgaaggtgggcacggtcacaatggggcccagtgcccggggcatctctgtggaggtggagtatggcccctgtgtggtagctagtgactgctggagtctgctgctcgagttcctacagagttttctaggcagccacacaccaggggctcccgcagtgtttgggaacagacatgatgcggtctacggcccagcagataccatggtccagtacatggaactcttcaacaagatccgcaagcagcagcaggtgccggtggctgggattcgttagtgatgagcagctgccagctgagctctgtcaccaggggtactccacaggaggagcaggtaatagagaagaggaaacctaaccaatgactgtggaataatatggaagaagatggaaaaaacttgtttaatgggtaagaaataaaaactgtaataaaacattattaatgaaagct

SEQ ID NO: 369346 - DNA, 2479 bp, Homo sapiens
cgtatttccggagtcccttctgagacagaaggttgtgttggggaactgaagcagtttctgtgggcggacagggaaccctgcgtttctactgtgtgattctgccaccttcctggcccgacgccatgggagtgacttgtgtgtcccagatgcctgtggccgagggcaagagtgttcagcaaaccgtagagctccttacccggaaattggagatgcttggggcagagaagcaaggaacattttgtgtggactgtgagacttaccatacggccgcctctacccttggcagccaaggtcagaccgggaagctgatgtatgtgatgcacaactcagagtacccattgagctgtttcgccctctttgagaatggcccttgccttattgctgacaccaactttgatgtgcttatggtgaagctcaagggctttttccagagtgctaaggccagcaagattgagacccggggcaccaggtaccagtactgtgacttcctggtgaaggtgggcacggtcacaatggggcccagtgcccggggcatctctgtggaggtggagtatggcccctgtgtggtagctagtgactgctggagtctgctgctcgagttcctacagagttttctaggcagccacacaccaggggctcccgcagtgtttgggaacagacatgatgcggtctacggcccagcagataccatggtccagtacatggaactcttcaacaagatccgcaagcagcagcaggtgccggtggctgggattcgttagtgatgagcagctgccagctgagctctgtcaccaggggtactccacaggaggagcaggtgctgactttcaggtccctggaccccagaaacccagggtagacatggactctactctccttctctggttctcagctgtggcttttgttctggggctgagtcccctccccaaccccctgactctcacacatagccccccatcagctgttttactccgtgccttactggatttggcctgtcctcaagaatggtaattatgaagagtggagaagtttggaccttgcctcctttaggggaaaggtaggacaggaatgtccctgcctggtactggtgggggaaatagtccgtatccccaactattaaggatttgtcccaggccaatggtgaacatgctgcattttatgtttggattgtgctgtaataagagcctcttccttccctcagaggatgtggctgggcttctatcctagagatggagtagaaggcacaactggtttgatagttactattttctgacctgtttgctgaagtgatttgcgaattgactttcctagggtgttgcctgagtcctttgaaatctccttctgacatctttcccttctgttgtgaaatatgttaagccacaggccaaactgctataagatcgaagtttgtttttttctcacctaataatagagaggtaatcagatggtctagggcagatttaactctacaaggttatcaggaactttgtttccttctgtcttattcagccattcccagtatgttttcttacccataagatcaaagcagactcatcagctccatatctgcattccactggggaaagagagagagaaaagagcagatttttaaaaaaagatatgactgagcattgctcagatcactgtggccacactttgctgaaagagatgctgggacatagaacctcttatctgggcagtcatgtgctgagttaaaactcagggattctgtgactacaagatgaaagacaatttggttgctgagatgcagttaatggcttctgttacatggagctcaatggacgtgcccaggaatgcttttggctgttattttgcagttaatacctcctgtaactaaagcatttgtttatgagttgacttgagagaagggctgatctcagagccgctttgagctaagttggattagtcacactaggaagttaattccacacctttcgtctaagtctcagtattgaggcctctccagttctcatgcaccctgatcttagggttagaatacttgaccctgatacctgcaccatgcttcatggttcctgagctctttctcctgtttcatttgagcctccaaactacatatttggtcatattgcctgcctaccccatgcctgctgcagaaatattcatccaggttaaccttgatatacacagagatggtcttggagaattgtgaatgtatgtactgtattgtcatcaaggatactgtcccttatttgaaggcatctaaagagaaactgttttcagatccaagtgctcagatctaaagcctctgcaacaagtcaggtggtggtcatgtttcccttctagttttggctgacaggaagctcagttcagtaccataactacagaacctgtcatctgtattttttgttctcaccccgtttttgttattttgtttctggttttttatattgaggtatgttttagatatagtttacaaaaataaaacgcacagatctta

SEQ ID NO: 369347 - DNA, 2973 bp, Homo sapiens
  misc_feature (47)..(47): n is a, c, g, or t
  misc_feature (73)..(73): n is a, c, g, or t
  misc_feature (80)..(84): n is a, c, g, or t
  misc_feature (96)..(96): n is a, c, g, or t
  misc_feature (98)..(98): n is a, c, g, or t
  misc_feature (100)..(100): n is a, c, g, or t
cagcaaccaccccacccccccccacaactatgtactagtcgagccgngtgtgattcagtcagagggtgagacntaccatnnnnncgcctctacccntngnagcaaggtcagaccgggaagctgatgtatgtgatgcacaactcagagtacccattgagctgtttcgccctctttgagaatggcccttgccttattgctgacaccaactttgatgtgcttatggtgaagctcaagggctttttccagagtgctaaggccagcaagattgagacccggggcaccaggtaccagtactgtgacttcctggtgaaggtgggcacggtcacaatggggcccagtgcccggggcatctctgtggaggtggagtatggcccctgtgtggtagctagtgactgctggagtctgctgctcgagttcctacagagttttctaggcagccacacaccaggggctcccgcagtgtttgggaacagacatgatgcggtctacggcccagcagataccatggtccagtacatggaactcttcaacaagatccgcaagcagcagcaggtgccggtggctgggattcgttagtgatgagcagctgccagctgagctctgtcaccaggggtactccacaggaggagcaggtgctgactttcaggtccctggaccccagaaacccagggtagacatggactctactctccttctctggttctcagctgtggcttttgttctggggctgagtcccctccccaaccccctgactctcacacatagccccccatcagctgttttactccgtgccttactggatttggcctgtcctcaagaatggtaattatgaagagtggagaagtttggaccttgcctcctttaggggaaaggtaggacaggaatgtccctgcctggtactggtgggggaaatagtccgtatccccaactattaaggatttgtcccaggccaatggtgaacatgctgcattttatgtttggattgtgctgtaataagagcctcttccttccctcagaggatgtggctgggcttctatcctagagatggagtagaaggcacaactggtttgatagttactattttctgacctgtttgctgaagtgatttgcgaattgactttcctagggtgttgcctgagtcctttgaaatctccttctgacatctttcccttctgttgtgaaatatgttaagccacaggccaaactgctataagatcgaagtttgtttttttctcacctaataatagagaggtaatcagatggtctagggcagatttaactctacaaggttatcaggaactttgtttccttctgtcttattcagccattcccagtatgttttcttacccataagatcaaagcagactcatcagctccatatctgcattccactggggaaagagagagagaaaagagcagatttttaaaaaaagatatgactgagcattgctcagatcactgtggccacactttgctgaaagagatgctgggacatagaacctcttatctgggcagtcatgtgctgagttaaaactcagggattctgtgactacaagatgaaagacaatttggttgctgagatgcagttaatggcttctgttacatggagctcaatggacgtgcccaggaatgcttttggctgttattttgcagttaatacctcctgtaactaaagcatttgtttatgagttgacttgagagaagggctgatctcagagccgctttgagctaagttggattagtcacactaggaagttaattccacacctttcgtctaagtctcagtattgaggcctctccagttctcatgcaccctgatcttagggttagaatacttgaccctgatacctgcaccatgcttcatggttcctgagctctttctcctgtttcatttgagcctccaaactacatatttggtcatattgcctgcctaccccatgcctgctgcagaaatattcatccaggttaaccttgatatacacagagatggtcttggagaattgtgaatgtatgtactgtattgtcatcaaggatactgtcccttatttgaaggcatctaaagagaaactgttttcagatccaagtgctcagatctaaagcctctgcaacaagtcaggtggtggtcatgtttcccttctagttttggctgacaggaagctcagttcagtaccataactacagaacctgtcatctgtattttttgttctcaccccgtttttgttattttgtttctggttttttatattgaggtatgttttagatatagtttacaaaaataaaacgcacagatcttaaaaaaaaaaaaacaaaaacaacaaaaaaaacaaaaaaaaaaaaaaaaaaaaaaaaaaaaacaaaaacacacaaacacaacacaaaaaaataaaccaccagacacacacaagaagcaaaaaaaaaagaaaacaaaaacgcagagaagacggcgagggggcgcgcgacataccgaccgaccacaggaggagtccaaacagcagcgagacacgccgagatcgcccttccacgcaaggaggggagcgcggacagagggacgccgcctgactacctgccgccccgcgcgccaccgcggcgtctgtgtacgcggcggagccggagcagacaaaaagactagcgatagtctaggggactagagttatgggtcaggctgaaggtgcctgcatcattggtctgtagggtggtgcatgtcatcacagtcataaggtacacataccatactcctaggaaaggtgcttatgtacgcgttatgttggtggcacagtctatatagaagtcgtcgactggtagtctagactactggttgcgttcaggttctaaacaacctatcacgtttatcaggtgatgctcgtagtctaagaatgatagagagcggattcggtgaatgtcatgttgcttagtcgtaaaactctattatatacggacggaggagagatgataaaagaaagaggaaggggaagg

SEQ ID NO: 369348 - DNA, 2446 bp, Homo sapiens
cgtatttccggagtcccttctgagacagaaggttgtgttggggaactgaagcagtttctgtgggcggacagggaaccctgcgtttctactgtgtgattctgccaccttcctggcccgacgccatgggagtgacttgtgtgtcccagatgcctgtggccgagggcaagagtgttcagcaaaccgtagagctccttacccggaaattggagatgcttggggcagagaagcaaggaacattttgtgtggactgtgagacttaccatacggccgcctctacccttggcagccaaggtcagaccgggaagctgatgtatgtgatgcacaactcagagtacccattgagctgtttcgccctctttgagaatggcccttgccttattgctgacaccaactttgatgtgcttatggtgaagctcaagggctttttccagagtgctaaggccagcaagattgagacccggggcaccaggtaccagtactgtgacttcctggtgaaggtgggcacggtcacaatggggcccagtgcccggggcatctctgtggaggtggagtatggcccctgtgtggtagctagtgactgctggagtctgctgctcgagttcctacagagttttctaggcagccacacaccaggggctcccgcagtgtttgggaacagacatgatgcggtctacggcccagcagataccatggtccagtacatggaactcttcaacaagatccgcaagcagcagcaggtgccggtggctgggattcgttagtgatgagcagctgccagctgagctctgtcaccaggggtactccacaggaggagcaggtgctgactttcaggtccctggaccccagaaacccagggtagacatggactctactctccttctctggttctcagctgtggcttttgttctggggctgagtcccctccccaaccccctgactctcacacatagccccccatcagctgttttactccgtgccttactggatttggcctgtcctcaagaatggtaattatgaagagtggagaagtttggaccttgcctcctttaggggaaaggtaggacaggaatgtccctgcctggtactggtgggggaaatagtccgtatccccaactattaaggatttgtcccaggccaatggtgaacatgctgcattttatgtttggattgtgctgtaataagagcctcttccttccctcagaggatgtggctgggcttctatcctagagatggagtagaaggcacaactggtttgatagttactattttctgacctgtttgctgaagtgatttgcgaattgactttcctagggtgttgcctgagtcctttgaaatctccttctgacatctttcccttctgttgtgaaatatgttaagccacaggccaaactgctataagatcgaagtttgtttttttctcacctaataatagagaggtaatcagatggtctagggcagatttaactctacaaggttatcaggaactttgtttccttctgtcttattcagccattcccagtatgttttcttacccataagatcaaagcagactcatcagctccatatctgcattccactggggaaagagagagagaaaagagcagatttttaaaaaaagatatgactgagcattgctcagatcactgtggccacactttgctgaaagagatgctgggacatagaacctcttatctgggcagtcatgtgctgagttaaaactcagggattctgtgactacaagatgaaagacaatttggttgctgagatgcagttaatggcttctgttacatggagctcaatggacgtgcccaggaatgcttttggctgttattttgcagttaatacctcctgtaactaaagcatttgtttatgagttgacttgagagaagggctgatctcagagccgctttgagctaagttggattagtcacactaggaagttaattccacacctttcgtctaagtctcagtattgaggcctctccagttctcatgcaccctgatcttagggttagaatacttgaccctgatacctgcaccatgcttcatggttcctgagctctttctcctgtttcatttgagcctccaaactacatatttggtcatattgcctgcctaccccatgcctgctgcagaaatattcatccaggttaaccttgatatacacagagatggtcttggagaattgtgaatgtatgtactgtattgtcatcaaggatactgtcccttatttgaaggcatctaaagagaaactgttttcagatccaagtgctcagatctaaagcctctgcaacaagtcaggtggtggtcatgtttcccttctagttttggagaacctgtcatctgtattttttgttctcaccccgtttttgttattttgtttctggttttttatattgaggtatgttttagatatagtttacaaaaataaaacgcacagatctta

SEQ ID NO: 369349 - DNA, 807 bp, Homo sapiens
cgtatttccggagtcccttctgagacagaaggttgtgttggggaactgaagcagtttctgtgggcggacagggaaccctgcgtttctactgtgtgattctgccaccttcctggcccgacgccatgggagtgacttgtgtgtcccagatgcctgtggccgagggcaagagtgttcagcaaaccgtagagctccttacccggaaattggagatgcttggggcagagaagcaaggaacattttgtgtggactgtgagacttaccatacggccgcctctacccttggcagccaaggtggagtatggcccctgtgtggtagctagtgactgctggagtctgctgctcgagttcctacagagttttctaggcagccacacaccaggggctcccgcagtgtttgggaacagacatgatgcggtctacggcccagcagataccatggtccagtacatggaactcttcaacaagatccgcaagcagcagcaggtgccggtggctgggattcgttagtgatgagcagctgccagctgagctctgtcaccaggggtactccacaggaggagcaggtaatagagaagaggaaacctaaccaatgactgtggaataatatggaagaagatggaaaaaacttgtttaatgggttgagaaagtggcgacttctataagacatggatagatgcaaacatgtagggcggttacggctcgcccaggaccactccatcctgaaccctcagaagtggtgctgcttagagtgtgccaccaccgagtccgtgtgggcctgcctcaagtgctcccacgtggcctgcggcc

SEQ ID NO: 369350 - DNA, 2070 bp, Homo sapiens
tgagatggagtctcgctttaccgcccaggctggagtgcagtggcactatctcagctcactgcaagctccacctcctgggttcacgccattctcctgcctcagcctccccagtagctgggactacaggcgctcaccaccacgcgcagctaattttttgtatttttagtagagacggggtttcaccgtgttagccaggatggtctcgatctcctgacctcgtgatccgcccgcctcggcctcccaaagtgctgggattacaggcgtgagccaccgcgcctggccaaaaaaagccatgctttttcatccttccagatcgtaacccaggtgttaagtttacatggaatgcctatgccccctcctcttcctagacgtagatatctcctctcccctaggaagtcttccttaactcatcctcagggagttatccacccttcttccagcacagggcacggcactaatggtgagctcttctcacatcttctgctgtggcttttgttctggggctgagtcccctccccaaccccctgactctcacacatagccccccatcagctgttttactccgtgccttactggatttggcctgtcctcaagaatggtaattatgaagagtggagaagtttggaccttgcctcctttaggggaaaggtaggacaggaatgtccctgcctggtactggtgggggaaatagtccgtatccccaactattaaggatttgtcccaggccaatggtgaacatgctgcattttatgtttggattgtgctgtaataagagcctcttccttccctcagaggatgtggctgggcttctatcctagagatggagtagaaggcacaactggtttgatagttactattttctgacctgtttgctgaagtgatttgcgaattgactttcctagggtgttgcctgagtcctttgaaatctccttctgacatctttcccttctgttgtgaaatatgttaagccacaggccaaactgctataagatcgaagtttgtttttttctcacctaataatagagaggtaatcagatggtctagggcagatttaactctacaaggttatcaggaactttgtttccttctgtcttattcagccattcccagtatgttttcttacccataagatcaaagcagactcatcagctccatatctgcattccactggggaaagagagagagaaaagagcagatttttaaaaaaagatatgactgagcattgctcagatcactgtggccacactttgctgaaagagatgctgggacatagaacctcttatctgggcagtcatgtgctgagttaaaactcagggattctgtgactacaagatgaaagacaatttggttgctgagatgcagttaatggcttctgttacatggagctcaatggacgtgcccaggaatgcttttggctgttattttgcagttaatacctcctgtaactaaagcatttgtttatgagttgacttgagagaagggctgatctcagagccgctttgagctaagttggattagtcacactaggaagttaattccacacctttcgtctaagtctcagtattgaggcctctccagttctcatgcaccctgatcttagggttagaatacttgaccctgatacctgcaccatgcttcatggttcctgagctctttctcctgtttcatttgagcctccaaactacatatttggtcatattgcctgcctaccccatgcctgctgcagaaatattcatccaggttaaccttgatatacacagagatggtcttggagaattgtgaatgtatgtactgtattgtcatcaaggatactgtcccttatttgaaggcatctaaagagaaactgttttcagatccaagtgctcagatctaaagcctctgcaacaagtcaggtggtggtcatgtttcccttctagttttggctgacaggaagctcagttcagtaccataactacagaacctgtcatctgtattttttgttctcaccccgtttttgttattttgtttctggttttttatattgaggtatgttttagatatagtttacaaaaataaaacgcacagatctta

SEQ ID NO: 369351 - DNA, 668 bp, Homo sapiens
  misc_feature (3)..(3): n is a, c, g, or t
  misc_feature (6)..(6): n is a, c, g, or t
  misc_feature (9)..(9): n is a, c, g, or t
ttnggnacnagctaactatctcacaatataggtccccaaccactgaccaaactccagtccaggcagccaccagctggcctggtcttgctgcttcctttagcggcttccaaggtccagggacagggggtctgggccaccaagaggctctgctaggctgtccctgcagccacagccaccccactggacccctgcctcccatctgagaggacagccctcttcctggagctgggatctgacacttgctgataccaacggcagataccaggtcaaggattcggtgacttgaagacaggcctcctctgttgctttgagtcaatttctagtacctggggcctaaatcttgactgcacaccggtcatattattgaggtaacgagatgtgagcagaaacaacctgtgtcacacctgggcagaagctttaaaggccagtgctgcccttgttggggaagcaagtatagatatgaatcgttccacaacgcggagcgccccctgccgacccatgctgggcgtgtactataggtataagaatagtctttggagcatcatctgagatagtgagccaagatcgtgcaactgcactccagcctgagtaacagagtgagactccatctcaaaacaaacaaataaacaaaacagaataaatatactcaggatatttacagacacttt

SEQ ID NO: 369352 - DNA, 621 bp, Homo sapiens
ccccatctctacagaaaattttaaaacttaaaaaaattaaaaagtaaacgttagacaggcatggtggtgtgtgtctgtagtcccagctacttgtgaggcttaggcgagaggatggcttgagcccaggaatttgaggctgtagtgggttttgactatgccactgcactccagcccgggtgacacagcaaaaccctatctcttaaaaacaaatcagatttactccaaatgccacttttggctctttatgatgacagctgacatttatagagcctttatgtgcaaagcgcagtggtaggatatctcgtttcacttctcgttgaagtggaagtcaagtctattcttatccttattttacagatgaggagactgaggatcagagagataaagtcacctgtccaaggtcatactgtggatgtagctctaacccaagccctcccgactgcagcacaaattctcagccactaccctattagccccttcatttgaaggtgtcttcatcattgccaagattccttttcctcccggccccctaagtcttcaggattccctcatctcatctccccagagaagccatgacaccatcttctccaaaaacaaagtcagcgctttcactgtagatgg

SEQ ID NO: 369353 - DNA, 1194 bp, Homo sapiens
  misc_feature (3)..(3): n is a, c, g, or t
  misc_feature (6)..(6): n is a, c, g, or t
  misc_feature (9)..(9): n is a, c, g, or t
ttnggnacnagctaactatctcacaatataggtccccaaccactgaccaaactccagtccaggcagccaccagctggcctggtcttgctgcttcctttagcggcttccaaggtccagggacagggggtctgggccaccaagaggctctgctaggctgtccctgcagccacagccaccccactggacccctgcctcccatctgagaggacagccctcttcctggagctgggatctgacacttgctgataccaacggcagataccaggtcaaggattcggtgacttgaagacaggcctcctctgttgctttgagtcaatttctagtacctggggcctaaatcttgactgcacaccggtcatattattgaggtaacgagatgtgagcagaaacaacctgtgtcacacctgggcagaagctttaaaggccagtgctgcccttgttggggaagcaagtatagatatgaatcgttccacaacgcggagcgccccctgccgacccatgctgggcgtgtactatagctcatggaatcttcacaacaaccaaggctcatttgatgggtgaagaaactgaggaccagagaagtgaagcaaagcaccatcatcatagagcttcaaggggcagagccacatcaccaaactgtctccgacaatggcctctgatctgtcctcaagctgatgctattggtcaaagggactaggcctacatagctaggaaaaattaggctcacctggcacttaaaaacagatatacagtatgccctgatggaagattgttgacatcccctatctcttcacttgtcctgtttagagcacttgaagatgctgctattccaggctacctcagcccaccccttcttatccatccattcatccatcttttcatcaacccactcatcacatcatttgtccatccatccttcccctaaccacctacccatctatccagctacttattcatccatttatcacatgcacctacatatctttccatccatctacttacccatccatgcatcatcctccacacccaaccatccacccataacatctttttattaatccactcatcacatcatttgtccatccatccttcccctaaccacctacccatctatccagctacttattcatccatttatcacatgcacctacatatctttccatccatctacttacccatccatgcatgggtacc

SEQ ID NO: 369354 - DNA, 891 bp, Homo sapiens
gtaggatgggaaggtgatgtgggaggggagataggggaagggctggagaggggccatattttaagaatgaagggtgggaacagccatagcctgatattggacacggtcccatagccagccagcatctggggtcctactcgattttgggcctatccacccttcacaaggacacggcatgtttgttatagcttctattaccttttctctttcattagctcatggaatcttcacaacaaccaaggctcatttgatgggtgaagaaactgaggaccagagaagtgaagcaaagcaccatcatcatagagcttcaaggggcagagccacatcaccaaactgtctccgacaatggcctctgatctgtcctcaagctgatgctattggtcaaagggactaggcctacatagctaggaaaaattaggctcacctggcacttaaaaacagatatacagtatgccctgatggaagattgttgacatcccctatctcttcacttgtcctgtttagagcacttgaagatgctgctattccaggctacctcagcccaccccttcttatccatccattcatccatcttttcatcaacccactcatcacatcatttgtccatccatccttcccctaaccacctacccatctatccagctacttattcatccatttatcacatgcacctacatatctttccatccatctacttacccatccatgcatcatcctccacacccaaccatccacccataacatctttttattaatccactcatcacatcatttgtccatccatccttcccctaaccacctacccatctatccagctacttattcatccatttatcacatgcacctacatatctttccatccatctacttacccatccatgcatgggtacc

SEQ ID NO: 369355 - DNA, 865 bp, Homo sapiens
gcagtgcccagcagctgcctcctcaccctagctgagctgaccacaagattccagacctcagctggagctgcagcctcatactggctgagtggctccaagacacagaaggaagcagggtggcaggctgacctcagccagctgcctgccccctctcctctgaggctggcctgggaccgatggggctcttccctccaggaggggtttccgggcctcctcttttcccctacctccctgtggagaactgtccacccctccagatatgctccagtgatgtcggaggggatgcctcaatctggcgagacgcagcggcaacaaaatctgctcagagacaaacggacatgttgctgatatgaatctcacttggtgaggaaactgaggctcagagaagaaacatcattttcccagtgagccaaggcaatggtgttagaactatctctacctggctccagagcttgtgtttatgcccctgcaccgatacggccttccatgaagcccggcccagaaagctttggagtctggttacatctctgccacgcaggcctggccttcccaggacaagagccccctgcagcttccagaaccccgtggtctcaagcagagagctgtcgcacttccttctttgccttctcatcctccaagtcccatcttagtcatcttcctccgggaaacagaacgccggggtcctcctctgtccccccatagcccccaaagctttacatcatcatcgtttagtcagatggtaattagactggttgtgtgcctcctccactggactgtgtcccatctaccattgtattcccaggacccacttgatataaataggctggatgaataactgagtgaataaaggatggaaatcgtccat

SEQ ID NO: 369356 - DNA, 280 bp, Homo sapiens
acatcatttgtccatccatccttcccctaaccacctacccatctatccagctacttattcatccatttatcacatgcacctacatatctttccatccatctacttacccatccatgcatcatcctccacacccaaccatccacccataacatctttttattaatccatccacccatctatccacccagccatctccccagttactcattcatttgtctcatccatccagctatttctccctctattccattcatgcatccctccacccatctatcacatc

SEQ ID NO: 369357 - DNA, 362 bp, Homo sapiens
ggtgggaacagccatagcctgatattggacacggtcccatagccagccagcatctggggtcctactcgattttgggcctatccacccttcacaaggacacggcatgtttgttatagcttctattaccttttctctttcattagctcatggaatcttcacaacaaccaaggctcatttgatgggtgaagaaactgaggaccagagaagtgaagcaaagcaccatcatcatagagcttcaaggggcagagccacatcaccaaactgtctccgacaatggcctctgatctgtcctcaagctgatgctattggtcaaagggactaggcctacatagctaggaaaaattaggctcacctggcactta

SEQ ID NO: 369358 - DNA, 975 bp, Homo sapiens
gcagtgcccagcagctgcctcctcaccctagctgagctgaccacaagattccagacctcagctggagctgcagcctcatactggctgagtggctccaagacacagaaggaagcagggtggcaggctgacctcagccagctgcctgccccctctcctctgaggctggcctgggaccgatggggctcttccctccaggaggggtttccgggcctcctcttttcccctacctccctgtggagaactgtccacccctccagatatgctccagtgatgtcggaggggatgcctcaatctggcgagacgcagcggcaacaaaatctgctcagagacaaacggacatgttgctgatatgaatctcacttggtgaggaaactgaggctcagagaagaaacatcattttcccagtgagccaaggcaatggtgttagaactatctctacctggctccagagcttgtgtttatgcccctgcaccgatacggccttccatgaagcccggcccagaaagctttggagtctggttacatctctgccacgcaggcctggccttcccaggacaagaggtaacgagatgtgagcagaaacaacctgtgtcacacctgggcagaagctttaaaggccagtgctgcccttgttggggaagcaagtatagatatgaatcgttccacaacgcggagcgccccctgccgacccatgctgggcgtgtactatagatgaggagactgaggatcagagagataaagtcacctgtccaaggtcatactgtggatgtagctctaacccaagccctcccgactgcagcacaaattctcagccactaccctattagccccttcatttgaaggtgtcttcatcattgccaagattccttttcctcccggccccctaagtcttcaggattccctcatctcatctccccagagaagccatgacaccatcttctccaaaaacaaagtcagcgctttcactgtagatgg

SEQ ID NO: 369359 - DNA, 782 bp, Homo sapiens
  misc_feature (3)..(3): n is a, c, g, or t
  misc_feature (6)..(6): n is a, c, g, or t
  misc_feature (9)..(9): n is a, c, g, or t
ttnggnacnagctaactatctcacaatataggtccccaaccactgaccaaactccagtccaggcagccaccagctggcctggtcttgctgcttcctttagcggcttccaaggtccagggacagggggtctgggccaccaagaggctctgctaggctgtccctgcagccacagccaccccactggacccctgcctcccatctgagaggacagccctcttcctggagctgggatctgacacttgctgataccaacggcagataccaggtcaaggattcggtgacttgaagacaggcctcctctgttgctttgagtcaatttctagtacctggggcctaaatcttgactgcacaccggtcatattattgaggtaacgagatgtgagcagaaacaacctgtgtcacacctgggcagaagctttaaaggccagtgctgcccttgttggggaagcaagtatagatatgaatcgttccacaacgcggagcgccccctgccgacccatgctgggcgtgtactatagatgaggagactgaggatcagagagataaagtcacctgtccaaggtcatactgtggatgtagctctaacccaagccctcccgactgcagcacaaattctcagccactaccctattagccccttcatttgaaggtgtcttcatcattgccaagattccttttcctcccggccccctaagtcttcaggattccctcatctcatctccccagagaagccatgacaccatcttctccaaaaacaaagtcagcgctttcactgtagatgg

SEQ ID NO: 369360 - DNA, 1038 bp, Homo sapiens
  misc_feature (3)..(3): n is a, c, g, or t
  misc_feature (6)..(6): n is a, c, g, or t
  misc_feature (9)..(9): n is a, c, g, or t
ttnggnacnagctaactatctcacaatataggtccccaaccactgaccaaactccagtccaggcagccaccagctggcctggtcttgctgcttcctttagcggcttccaaggtccagggacagggggtctgggccaccaagaggctctgctaggctgtccctgcagccacagccaccccactggacccctgcctcccatctgagaggacagccctcttcctggagctgggatctgacacttgctgataccaacggcagataccaggtaacgagatgtgagcagaaacaacctgtgtcacacctgggcagaagctttaaaggccagtgctgcccttgttggggaagcaagtatagatatgaatcgttccacaacgcggagcgccccctgccgacccatgctgggcgtgtactatagctcatggaatcttcacaacaaccaaggctcatttgatgggtgaagaaactgaggaccagagaagtgaagcaaagcaccatcatcatagagcttcaaggggcagagccacatcaccaaactgtctccgacaatggcctctgatctgtcctcaagctgatgctattggtcaaagggactaggcctacatagctaggaaaaattaggctcacctggcacttatcacttgtcctgtttagagcacttgaagatgctgctattccaggctacctcagcccaccccttcttatccatccattcatccatcttttcatcaacccactcatcacatcatttgtccatccatccttcccctaaccacctacccatctatccagctacttattcatccatttatcacatgcacctacatatctttccatccatctacttacccatccatgcatcatcctccacacccaaccatccacccataacatctttttattaatccactcatcacatcatttgtccatccatccttcccctaaccacctacccatctatccagctacttattcatccatttatcacatgcacctacatatctttccatccatctacttacccatccatgcatgggtacc

SEQ ID NO: 369361 - DNA, 637 bp, Homo sapiens
  misc_feature (562)..(562): n is a, c, g, or t
ctgacattgagcattttaatgagtgcctgggcaatatcaaggctggttgtaatatcaaggctggttgttcagggagcacaatgactctctaagcctggattcctcacttgcaaacgagagtggtgctgctcacaactcaggtactatttggagaatcaacaagatttgacgtgacatgataaacccagagaatgaaagccaggaagcatttaatacatgctacaatttttcctttgcttttaaaaagttgatttgttatcaagagaagatgacagaaataataccatttcgtaactttccattcttcactttgatagtttatcatatatgtgtttatttttctcataataatatacaggaaacacattatattttcctagcgctagtcaaattctatttaagtttgttaacacactaaatcattgtcagataggggtcatcattaggtttcattggtgttggtcaaagtggacactatttaaagacatcacagcctggttcccaccctcagggcacagggagcagaaacaatgtgttcattttgtcttaaaagtcccatcancaggtcgacagggccagtcaacacagacatgttctaaatatttgcttacgggtggacataattacttaaaataca

SEQ ID NO: 369362 - DNA, 289 bp, Homo sapiens
cccttcctttgacgcctgaccttagaacgcctgacctttggagcctgacctttggactctagttccaaggaaaaaattcccagcgttttctacattcggtgctgcgtcatctgaaatcggcacattccatggaggaaggagtcctgctttgttgcatgtatcctagggtttaatgttggtaaatgagtcactctagcatttgtagaaggctccctgagactcctgcagcctagttccaagaaaaaaactcccagcgttttctacattcggcgctacgtacaaaggtcag

SEQ ID NO: 369363 - DNA, 2548 bp, Homo sapiens
  misc_feature (1429)..(1429): n is a, c, g, or t
gtatttttagttgagacgggattttgccatgttggctaggctggtctcgaactcctgacctcaggtgatccggccacctcagcctcccaaagtgctgggattacaggcatgagccactgtgcctggccgtggaccttcttttcaaagaattatggaggcttattttagttcccctaacttggaaatctcctgaggaagaaaggtgactacaggcatttgtcaaaaatttgtaaaggcaagtttattagcctctgccatcgggggcaaagaataatagctaaggcaaacaatagacacaccaaaaagcctgggaggaaaagctggaaagtaagatattttggagaataaaggcttttaaaacttccacatattcttgggaatccaaaaggccacatgtacatgcagggtgagcaaatagagaagacttgagaaagccttaaactctcacctctggctaaccatgaggcttgctcaaataggaagtgaaaactaaggtgaatttgttgcttagctgaatgttgaaggtgtgccccaacacttacacagagcctactggtaaagacagagtgttttcttttgtcttggtttcaggcatttaaggaaatctgtttctcttttggatcactagctgcaaattaagctaacagaacaggagctcagctggtcacacacagcaacgaatacagactttataaagttcagaaaagttaccaaacagtggtaaccataacaagtaccaacaatgaactatggggagggaggagaatctgatttccagagttaccacattataatactattcaaaatgtcacatttttagcaaagattacatgacaaggaaaaaccagaaaagtatggcccatacacaggtaaaaaaagaaattaatagaaactacccctgaagaagcacagacttcggatgtacaaaacaaagacttttcatcaactcttttagatatgctagaagagctaaaggaaaccatggacagagaacaaaaaaattaggaaagcaatgtctcatccaatacagaatatcaataaagagattgaaattgtagaaaagaaccaaatagaaattctggagttgaaaagtattataactaaaactgaaaattcactagaggtattcagcagcagactggagaagtcagaagaaagaatcaacaggcttcaagataggtcaattaagattatacagtctgaggagcagaaaggaaaaagaatgaagaaaaatgaacagagcataaaagacctctgggactctatcaagcataccagtatatgcatgaggggagtcccagaaggagaagaaagagagaaagggacataatatttgaagaaataatggtagaaaatgtcccagctttgatgaaatacatgaatctagatattcaagaggctcaaagaaccctaaatagggtaaactcanaaagacccacaccggaatgcaaaagtgagctgggtgtggtggcacgtgcctgtggtcccagctactcgagaggctaaggcaggaaaatcgcttgaacccaggaggcagagattgcggtgagccgggattgcgccagtgcactccagctgggcgacagagcgagattccatctcgaaaaaaaaaaaaaaacaaaaaactattgctgcagtcattcagatggaaatggggaaagaataatattaactgatttcaaaaaggacttgaagatgtgaatcatctattttgctgaagaaatcttaactctttgaaattactttttgttgctgttgtcatactcttaggtgccaaactgcggtaaattttttatcagtgaagtggaagcatgtgttttgttgttttgggaatttttatcaagtatcttcagagaagattatttcctgctttatcttcaaaaactggaaaggaagggtcaaagaaaagacagtagctggccggtcatggtggctcatgcctgtaatcccaacactttgggaggctgaggtgggcagatcacctgaggttgggagttcgaggccagcctgaccaacgtggagaaatgccatctctactaaagatgcaaggattggccgggcatggtggcgcgtgcctgtgatcccagctgctcaggaggctgaggcaggagaatcgcttggacctgggaggtggaggttgcggtgagctgagatcacgccattgcactccagcctgggcaacaagcgaaactctgtctcaaaaaaaaaagaaaagacagtagcttatgttcatgtcaagcacctctcatcacagtctagttccaaggaaaaaattcccagcgttttctacattcggtgctgcgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtga

SEQ ID NO: 369364 - DNA, 2623 bp, Homo sapiens
  misc_feature (1504)..(1504): n is a, c, g, or t
agcgggttcaaggcagaaggccgtgcgtcagggcggccctcagcggagatgcgtgcacggagcggggagcgctgctcggggcagggaatgaaagcggcgcttgagactggaaatttagggagatgagttccttgggaacaacgctgaaccatctcactgccccaccctaccccttgttatttttttttgagacaggtcttgcgctgtcgtccagtctgagtgcagtgacgcgatcacggctcactgcagcctcgacctccggggcttacgggtcatcccacctcagccctctaagtagctggcaccacgggcatgcaccaccacacccggctaattttttaaaaaaagtttttccggagatagggtctcgctgtgttacccaggctggtctcgaacccctggcctgaagcgatcctcccgcctcggcctcccaaagtgctgggattacaggcgtgagccactgcgctcggcttttcacccctttctaacgttttccatacccagcggtgccctgcccaccctctctttatctctcacttttccctcctctgtttcttcctcgctgaagtccattggtgaaagaaaattcatgtgaaagttctcagagtcgtccttgtctactccactaccaaatgttgaagttcttcaagaatcagtcctttggaggcatttaaggaaatctgtttctcttttggatcactagctgcaaattaagctaacagaacaggagctcagctggtcacacacagcaacgaatacagactttataaagttcagaaaagttaccaaacagtggtaaccataacaagtaccaacaatgaactatggggagggaggagaatctgatttccagagttaccacattataatactattcaaaatgtcacatttttagcaaagattacatgacaaggaaaaaccagaaaagtatggcccatacacaggtaaaaaaagaaattaatagaaactacccctgaagaagcacagacttcggatgtacaaaacaaagacttttcatcaactcttttagatatgctagaagagctaaaggaaaccatggacagagaacaaaaaaattaggaaagcaatgtctcatccaatacagaatatcaataaagagattgaaattgtagaaaagaaccaaatagaaattctggagttgaaaagtattataactaaaactgaaaattcactagaggtattcagcagcagactggagaagtcagaagaaagaatcaacaggcttcaagataggtcaattaagattatacagtctgaggagcagaaaggaaaaagaatgaagaaaaatgaacagagcataaaagacctctgggactctatcaagcataccagtatatgcatgaggggagtcccagaaggagaagaaagagagaaagggacataatatttgaagaaataatggtagaaaatgtcccagctttgatgaaatacatgaatctagatattcaagaggctcaaagaaccctaaatagggtaaactcanaaagacccacaccggaatgcaaaagtgagctgggtgtggtggcacgtgcctgtggtcccagctactcgagaggctaaggcaggaaaatcgcttgaacccaggaggcagagattgcggtgagccgggattgcgccagtgcactccagctgggcgacagagcgagattccatctcgaaaaaaaaaaaaaaacaaaaaactattgctgcagtcattcagatggaaatggggaaagaataatattaactgatttcaaaaaggacttgaagatgtgaatcatctattttgctgaagaaatcttaactctttgaaattactttttgttgctgttgtcatactcttaggtgccaaactgcggtaaattttttatcagtgaagtggaagcatgtgttttgttgttttgggaatttttatcaagtatcttcagagaagattatttcctgctttatcttcaaaaactggaaaggaagggtcaaagaaaagacagtagctggccggtcatggtggctcatgcctgtaatcccaacactttgggaggctgaggtgggcagatcacctgaggttgggagttcgaggccagcctgaccaacgtggagaaatgccatctctactaaagatgcaaggattggccgggcatggtggcgcgtgcctgtgatcccagctgctcaggaggctgaggcaggagaatcgcttggacctgggaggtggaggttgcggtgagctgagatcacgccattgcactccagcctgggcaacaagcgaaactctgtctcaaaaaaaaaagaaaagacagtagcttatgttcatgtcaagcacctctcatcacagtctagttccaaggaaaaaattcccagcgttttctacattcggtgctgcgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtga

SEQ ID NO: 369365 - DNA, 2107 bp, Homo sapiens
  misc_feature (988)..(988): n is a, c, g, or t
cccgggccgctgcccctcaccggacgccgcgcgccaccggccctccgcggggcaggggctgctgcgagctcgccgggcgccctttagacagtcgtccttgtctactccactaccaaatgttgaagttcttcaagaatcagtcctttggaggcatttaaggaaatctgtttctcttttggatcactagctgcaaattaagctaacagaacaggagctcagctggtcacacacagcaacgaatacagactttataaagttcagaaaagttaccaaacagtggtaaccataacaagtaccaacaatgaactatggggagggaggagaatctgatttccagagttaccacattataatactattcaaaatgtcacatttttagcaaagattacatgacaaggaaaaaccagaaaagtatggcccatacacaggtaaaaaaagaaattaatagaaactacccctgaagaagcacagacttcggatgtacaaaacaaagacttttcatcaactcttttagatatgctagaagagctaaaggaaaccatggacagagaacaaaaaaattaggaaagcaatgtctcatccaatacagaatatcaataaagagattgaaattgtagaaaagaaccaaatagaaattctggagttgaaaagtattataactaaaactgaaaattcactagaggtattcagcagcagactggagaagtcagaagaaagaatcaacaggcttcaagataggtcaattaagattatacagtctgaggagcagaaaggaaaaagaatgaagaaaaatgaacagagcataaaagacctctgggactctatcaagcataccagtatatgcatgaggggagtcccagaaggagaagaaagagagaaagggacataatatttgaagaaataatggtagaaaatgtcccagctttgatgaaatacatgaatctagatattcaagaggctcaaagaaccctaaatagggtaaactcanaaagacccacaccggaatgcaaaagtgagctgggtgtggtggcacgtgcctgtggtcccagctactcgagaggctaaggcaggaaaatcgcttgaacccaggaggcagagattgcggtgagccgggattgcgccagtgcactccagctgggcgacagagcgagattccatctcgaaaaaaaaaaaaaaacaaaaaactattgctgcagtcattcagatggaaatggggaaagaataatattaactgatttcaaaaaggacttgaagatgtgaatcatctattttgctgaagaaatcttaactctttgaaattactttttgttgctgttgtcatactcttaggtgccaaactgcggtaaattttttatcagtgaagtggaagcatgtgttttgttgttttgggaatttttatcaagtatcttcagagaagattatttcctgctttatcttcaaaaactggaaaggaagggtcaaagaaaagacagtagctggccggtcatggtggctcatgcctgtaatcccaacactttgggaggctgaggtgggcagatcacctgaggttgggagttcgaggccagcctgaccaacgtggagaaatgccatctctactaaagatgcaaggattggccgggcatggtggcgcgtgcctgtgatcccagctgctcaggaggctgaggcaggagaatcgcttggacctgggaggtggaggttgcggtgagctgagatcacgccattgcactccagcctgggcaacaagcgaaactctgtctcaaaaaaaaaagaaaagacagtagcttatgttcatgtcaagcacctctcatcacagtctagttccaaggaaaaaattcccagcgttttctacattcggtgctgcgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtga

SEQ ID NO: 369366 - DNA, 2793 bp, Homo sapiens
  misc_feature (1429)..(1429): n is a, c, g, or t
gtatttttagttgagacgggattttgccatgttggctaggctggtctcgaactcctgacctcaggtgatccggccacctcagcctcccaaagtgctgggattacaggcatgagccactgtgcctggccgtggaccttcttttcaaagaattatggaggcttattttagttcccctaacttggaaatctcctgaggaagaaaggtgactacaggcatttgtcaaaaatttgtaaaggcaagtttattagcctctgccatcgggggcaaagaataatagctaaggcaaacaatagacacaccaaaaagcctgggaggaaaagctggaaagtaagatattttggagaataaaggcttttaaaacttccacatattcttgggaatccaaaaggccacatgtacatgcagggtgagcaaatagagaagacttgagaaagccttaaactctcacctctggctaaccatgaggcttgctcaaataggaagtgaaaactaaggtgaatttgttgcttagctgaatgttgaaggtgtgccccaacacttacacagagcctactggtaaagacagagtgttttcttttgtcttggtttcaggcatttaaggaaatctgtttctcttttggatcactagctgcaaattaagctaacagaacaggagctcagctggtcacacacagcaacgaatacagactttataaagttcagaaaagttaccaaacagtggtaaccataacaagtaccaacaatgaactatggggagggaggagaatctgatttccagagttaccacattataatactattcaaaatgtcacatttttagcaaagattacatgacaaggaaaaaccagaaaagtatggcccatacacaggtaaaaaaagaaattaatagaaactacccctgaagaagcacagacttcggatgtacaaaacaaagacttttcatcaactcttttagatatgctagaagagctaaaggaaaccatggacagagaacaaaaaaattaggaaagcaatgtctcatccaatacagaatatcaataaagagattgaaattgtagaaaagaaccaaatagaaattctggagttgaaaagtattataactaaaactgaaaattcactagaggtattcagcagcagactggagaagtcagaagaaagaatcaacaggcttcaagataggtcaattaagattatacagtctgaggagcagaaaggaaaaagaatgaagaaaaatgaacagagcataaaagacctctgggactctatcaagcataccagtatatgcatgaggggagtcccagaaggagaagaaagagagaaagggacataatatttgaagaaataatggtagaaaatgtcccagctttgatgaaatacatgaatctagatattcaagaggctcaaagaaccctaaatagggtaaactcanaaagacccacaccggaatgcaaaagtgagctgggtgtggtggcacgtgcctgtggtcccagctactcgagaggctaaggcaggaaaatcgcttgaacccaggaggcagagattgcggtgagccgggattgcgccagtgcactccagctgggcgacagagcgagattccatctcgaaaaaaaaaaaaaaacaaaaaactattgctgcagtcattcagatggaaatggggaaagaataatattaactgatttcaaaaaggacttgaagatgtgaatcatctattttgctgaagaaatcttaactctttgaaattactttttgttgctgttgtcatactcttaggtgccaaactgcggtaaattttttatcagtgaagtggaagcatgtgttttgttgttttgggaatttttatcaagtatcttcagagaagattatttcctgctttatcttcaaaaactggaaaggaagggtcaaagaaaagacagtagctggccggtcatggtggctcatgcctgtaatcccaacactttgggaggctgaggtgggcagatcacctgaggttgggagttcgaggccagcctgaccaacgtggagaaatgccatctctactaaagatgcaaggattggccgggcatggtggcgcgtgcctgtgatcccagctgctcaggaggctgaggcaggagaatcgcttggacctgggaggtggaggttgcggtgagctgagatcacgccattgcactccagcctgggcaacaagcgaaactctgtctcaaaaaaaaaagaaaagacagtagcttatgttcatgtcaagcacctctcatcacagtctagttccaaggaaaaaattcccagcgttttctacattcggtgctgcgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggcttttgtatcgtaacctgaaactggcttagtactttttcctaaaagctcaggatttgagaatgaggaccccttcgccaggaaaatggcatgaacccaggaggcagagtttgcaatgagccgagatcgcgccactgcactccagactgggtgagagagctagactccatctcga

SEQ ID NO: 369367 - DNA, 1880 bp, Homo sapiens
  misc_feature (761)..(761): n is a, c, g, or t
gaactgccaaagttatttttaagtggctgtgacattttatattctaccagcagtgaatgaaatttccaatttctcatcctgggagccaaggaggagaatctgatttccagagttaccacattataatactattcaaaatgtcacatttttagcaaagattacatgacaaggaaaaaccagaaaagtatggcccatacacaggtaaaaaaagaaattaatagaaactacccctgaagaagcacagacttcggatgtacaaaacaaagacttttcatcaactcttttagatatgctagaagagctaaaggaaaccatggacagagaacaaaaaaattaggaaagcaatgtctcatccaatacagaatatcaataaagagattgaaattgtagaaaagaaccaaatagaaattctggagttgaaaagtattataactaaaactgaaaattcactagaggtattcagcagcagactggagaagtcagaagaaagaatcaacaggcttcaagataggtcaattaagattatacagtctgaggagcagaaaggaaaaagaatgaagaaaaatgaacagagcataaaagacctctgggactctatcaagcataccagtatatgcatgaggggagtcccagaaggagaagaaagagagaaagggacataatatttgaagaaataatggtagaaaatgtcccagctttgatgaaatacatgaatctagatattcaagaggctcaaagaaccctaaatagggtaaactcanaaagacccacaccggaatgcaaaagtgagctgggtgtggtggcacgtgcctgtggtcccagctactcgagaggctaaggcaggaaaatcgcttgaacccaggaggcagagattgcggtgagccgggattgcgccagtgcactccagctgggcgacagagcgagattccatctcgaaaaaaaaaaaaaaacaaaaaactattgctgcagtcattcagatggaaatggggaaagaataatattaactgatttcaaaaaggacttgaagatgtgaatcatctattttgctgaagaaatcttaactctttgaaattactttttgttgctgttgtcatactcttaggtgccaaactgcggtaaattttttatcagtgaagtggaagcatgtgttttgttgttttgggaatttttatcaagtatcttcagagaagattatttcctgctttatcttcaaaaactggaaaggaagggtcaaagaaaagacagtagctggccggtcatggtggctcatgcctgtaatcccaacactttgggaggctgaggtgggcagatcacctgaggttgggagttcgaggccagcctgaccaacgtggagaaatgccatctctactaaagatgcaaggattggccgggcatggtggcgcgtgcctgtgatcccagctgctcaggaggctgaggcaggagaatcgcttggacctgggaggtggaggttgcggtgagctgagatcacgccattgcactccagcctgggcaacaagcgaaactctgtctcaaaaaaaaaagaaaagacagtagcttatgttcatgtcaagcacctctcatcacagtctagttccaaggaaaaaattcccagcgttttctacattcggtgctgcgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtga

SEQ ID NO: 369368 - DNA, 451 bp, Homo sapiens
tagatctgccttcttgggatgtattcaaggatgctagccgtgtttgagactgtaaatatgtctagtgaatagggcttcaggctgtgtgtgtttgccttgttttgcacagaattcggcacagccccaagcacagatgggtgcttcataaatattgttgaaggatgatgacacaaaggattatttaatacctatggacctcaggccacaaacatactttcaatgtgttttacttctgaaatcatttgaaccaaaatgtttcagcaacacagattcatctgcaaccacaaatcagacacatttagaatgacaaagccccaaaagaatgccattttcaaggctgaaactgtattattctgggctaaatggaatccttgttttagtgacactgtaagagtagaaattaaagacactgaaaatcttcccttggggaaccacaattatctgtgaacaa

SEQ ID NO: 369369 - DNA, 89 bp, Homo sapiens
acaatggtaaagagctggaagttaacatcatccccaacccatggtaatggttcccaaattaggagatcagccttggtcatgtcaatgcc

SEQ ID NO: 369370 - DNA, 1515 bp, Homo sapiens
tttttgacctcattaaagatatgtcgttcatttattctgaatcttatattgatagataataccagaagatttcagcatagcagataaaatacagcaaatcctaaccagcacaggttttagtgacaaacgggcccgttccatggacatagatgacttcatcaggtaattacatttttgttttcctaagtgtttacatttctttactgtgacaccttcagattggagattttaaaggcttttaagcggtataaggtgctacctgggagagttattgcatagcacttccatggcatggaatagtatttggtgtagaagatggaggctagttagctgcagcagaatgaacattttctttaagaacagtagtaaagaacagtccgagccagaagattgcctttgtgttaatgtggtgtgcaggttccaatgtggtgtgcaggttcctcccttcctgctccttccccaactctcattcatagtcttagtcttaatagcttatccctccaaaatagtccataaggtagaaaaatcataatacatgtaactggatctgatttttaaaatttccttactgggaatagctgttgttaaatcaatcttaagcatacaataatgccagttagaatcctacctggttatccatttaggaataatacagttttgtagcctgaagcaagttctacacttctcaagtaaaaagctgtcataattatctaggtaatttagaccaaaatttgttttgcttgaattaagcaagtaagtcttatgaaaacagaataaggcttcaattaattacccaggtaattactaacctgtacttactgtttttaatcattaagatgttaactttcagaaggtcttgcctatttagccaattcacttttaaagcttccatgttctagaggctgaataaaaaatgagagtagattgttctaaaagtcattggtttgactttttctaagctggaaacacagttctatataactaagacaaatggagtttatattttattggctggctagcagtactactgagtcattttagatgttaatcctaggcattgaatactattcataaatatctactttgcttttttagaaatttatctggacctgtttctatgggccagcctaaacataacctcaggtctaaagagaaatattttctctttttcttcattttcactaaatttcctcaaagttattgggcatgtgcagtttactaactagaatctattaagtacataggtatctacagagagaaacaatgtgtatttaatttgaatataaacaacagctcaagagaggaagaaggggcatgtaagattggtttttcatctgacttctgccaattccaaacagcttcttgttcagttaccttgaaacaaatgccagtgagttcttaggcctgggataatgaaagtctaagataattttagtcaaattcattacgacataaaggctctaatgaaagaggcaccaacatggcatggttttaaccaatacatatcttataaat

SEQ ID NO: 369371 - DNA, 1598 bp, Homo sapiens
agcaggaggagctcagagcgtacgggagggggcggacccttgcccctccggcgcttgggccagagtggtgcgggcggcgcgtggcggcgatccccacgtggtggctttctcacgctagccctctttggtcctccttgacgtcccgggcctgtgggcccgctttctgccgagatgccgaaggtcaagtcgggggccatcggccgccgccgcgggcggcaggagcagcgccgggagctgaagagcgctggaggactcatgttcaacacggggattgggcagcacattttgaaaaatcctctcattattaacagcattatcgataaggctgccttaagaccaactgatgtagtgctggaagttggacctggaactggcaacatgactgtaaagttgttagaaaaggcaaaaaaggttgttgcttgtgaacttgacccaaggctagtagctgaacttcacaaaagagttcagggcacgcctgtggccagcaaacttcaagtactggtgggtgatgtgctgaaaacagatttgccattctttgatacttgtgtggcaaatttgccttatcagatctcttcgccttttgtcttcaagctgttgctacatcgaccttttttcaggtgtgctatacttatgtttcaaagagaatttgccctccgactggttgcaaaacctggagataagttatactgcagactctcaattaatacacagctgttggcacgtgtggaccatctaatgaaagtgggaaagaataacttcagaccaccgcccaaggtggaatccagtgttgtaaggatagaacctaagaatccaccaccacccatcaattttcaggaatgggatggtctagtaaggataacctttgttaggaaaaacaagacactctctgctgcatttaaatcaagtgcagtgcaacaactcttggaaaaaaactacagaattcactgttcagtccataatattataataccagaagatttcagcatagcagataaaatacagcaaatcctaaccagcacaggttttagtgacaaacgggcccgttccatggacatagatgacttcatcagattgctacatggattcaacgcagaaggtattcatttttcctaggtatttggaaaacagaaattttcaaggtcaagaaaagaaatgaattttgtattttttgtatttgagaagataatgcttttgctttactgagacattatttacttgactatttttggttcaatactactactgttgtcaccatttatgattctgaattttaaagttggaaagttctaagtatcaaagtttttaatatataatgctggtccaatctattcataataatcttcaagttcaggagccgcagagacgcacaactttacacttatcatttctaacagtttattgtataaagatgttactcttctatttactgttatatactgtaaggccttctttaggcctttagctctgttcctccagtaataaaaaagttaaaatatgcttcactagtcacacattccccataccatttcgtgttattcacattccccgtaccatttcttgttattcacatgtacagtaaaacaattgtttcttaaatt

SEQ ID NO: 369372 - DNA, 1255 bp, Homo sapiens
agcaggaggagctcagagcgtacgggagggggcggacccttgcccctccggcgcttgggccagagtggtgcgggcggcgcgtggcggcgatccccacgtggtggctttctcacgctagccctctttggtcctccttgacgtcccgggcctgtgggcccgctttctgccgagatgccgaaggtcaagtcgggggccatcggccgccgccgcgggcggcaggagcagcgccgggagctgaagagcgctggaggactcatgttcaacacggggattgggcagcacattttgaaaaatcctctcattattaacagcattatcgataaggctgccttaagaccaactgatgtagtgctggaagttggacctggaactggcaacatgactgtaaagttgttagaaaaggcaaaaaaggttgttgcttgtgaacttgacccaaggctagtagctgaacttcacaaaagagttcagggcacgcctgtggccagcaaacttcaagtactggtgggtgatgtgctgaaaacagatttgccattctttgatacttgtgtggcaaatttgccttatcagatctcttcgccttttgtcttcaagctgttgctacatcgaccttttttcaggtgtgctatacttatgtttcaaagagaatttgccctccgactggttgcaaaacctggagataagttatactgcagactctcaattaatacacagctgttggcacgtgtggaccatctaatgaaagtgggaaagaataacttcagaccaccgcccaaggtggaatccagtgttgtaaggatagaacctaagaatccaccaccacccatcaattttcaggaatgggatggtctagtaaggataacctttgttaggaaaaacaagacactctctgctgcatttaaatcaagtgcagtgcaacaactcttggaaaaaaactacagaattcactgttcagtccataatattgtcagtgctgctgtgtatcctgtgaaacagatatgagcaactttgattactccaccctgtcctctaactactgacagttgtttttagccataacaagaatcagattcagcagttacaggttcctcaaagctgtagatatgtgtagcttgcacaacttaaaataattgtgtagtttactgtcctctgaattgtgaccacgtcttgtttcttgctcacatagcagttacaaatatagttattactttctttgtatagaaattgaaataaagttcatatggctcaatagcagatt

SEQ ID NO: 369373 - DNA, 1047 bp, Homo sapiens
  misc_feature (876)..(876): n is a, c, g, or t
  misc_feature (922)..(922): n is a, c, g, or t
  misc_feature (925)..(926): n is a, c, g, or t
tgagacagagtcttgctctgtcacccaggctggactccagtggcacaatctcagctcactgcaacctccgcctcctgggttcaggcaaatctcctgcctcaaccacccgagtagctgggattacaggcatgtgccaccatgccaggctaatttttgtatttttagtagagacggggtttcaccatgttggccagactgttctcgaactactgacctcaggtaatccacccgcctcagcctcccaaagtgctgggattacaggcataagccactgcgcccagccagtaacgtttctttaataactagtattaggagtgggtgggctctgtaagcatgctgtattcatgttttagtattaatggtatagaactatataccgttatgtgctacaaattagcttttcagtaccattccattttgatttcttttttcagattgctacatggattcaacgcagaaggtattcatttttcctaggtatttggaaaacagaaattttcaaggtcaagaaaagaaatgaattttgtattttttgtatttgagaagataatgcttttgctttactgagacattatttacttgactatttttggttcaatactactactgttgtcaccatttatgattctgaattttaaagttggaaagttctaagtatcaaagtttttaatatataatgctggtccaatctattcataataatcttcaagttcaggagccgcagagacgcacaactttacacttatcatttctaacagtttattgtataaagatgttactcttctatttactgttatatactgtaaggccttctttaggcctttagctctgttcctccagtaataaaaaagttaaaataaaaccacaaccaccccnaacaaccaccccgctcccccccccaaccaaacccgcggaaaataancanncaatgggcctcttgggcctcaaggggagagttttgggccccttccctttagggggggtaattaaggacccttgtccatgactccttgccctggccttcgggcgggggaagcgggttaattt

SEQ ID NO: 369374 - DNA, 920 bp, Homo sapiens
tgagacagagtcttgctctgtcacccaggctggactccagtggcacaatctcagctcactgcaacctccgcctcctgggttcaggcaaatctcctgcctcaaccacccgagtagctgggattacaggcatgtgccaccatgccaggctaatttttgtatttttagtagagacggggtttcaccatgttggccagactgttctcgaactactgacctcaggtaatccacccgcctcagcctcccaaagtgctgggattacaggcataagccactgcgcccagccagtaacgtttctttaataactagtattaggagtgggtgggctctgtaagcatgctgtattcatgttttagtattaatggtatagaactatataccgttatgtgctacaaattagcttttcagtaccattccattttgatttcttttttcagattgctacatggattcaacgcagaaggtattcatttttcctaggtatttggaaaacagaaattttcaaggtcaagaaaagaaatgaattttgtattttttgtatttgagaagataatgcttttgctttactgagacattatttacttgactatttttggttcaatactactactgttgtcaccatttatgattctgaattttaaagttggaaagttctaagtatcaaagtttttaatatataatgctggtccaatctattcataataatcttcaagttcaggagccgcagagacgcacaactttacacttatcatttctaacagtttattgtataaagatgttactcttctatttactgttatatactgtaaggccttctttaggcctttagctctgttcctccagtaataaaaaagttaaaataaaaaaaaaaacaacggcgccaacaaaaaataagcaaaacgactcgggctctttggcctcac

SEQ ID NO: 369375 - DNA, 2820 bp, Homo sapiens
agcaggaggagctcagagcgtacgggagggggcggacccttgcccctccggcgcttgggccagagtggtgcgggcggcgcgtggcggcgatccccacgtggtggctttctcacgctagccctctttggtcctccttgacgtcccgggcctgtgggcccgctttctgccgagatgccgaaggtcaagtcgggggccatcggccgccgccgcgggcggcaggagcagcgccgggagctgaagagcgctggaggactcatgttcaacacggggattgggcagcacattttgaaaaatcctctcattattaacagcattatcgataaggttgttgcttgtgaacttgacccaaggctagtagctgaacttcacaaaagagttcagggcacgcctgtggccagcaaacttcaagtactggtgggtgatgtgctgaaaacagatttgccattctttgatacttgtgtggcaaatttgccttatcagatctcttcgccttttgtcttcaagctgttgctacatcgaccttttttcaggtgtgctatacttatgtttcaaagagaatttgccctccgactggttgcaaaacctggagataagttatactgcagactctcaattaatacacagctgttggcacgtgtggaccatctaatgaaagtgggaaagaataacttcagaccaccgcccaaggtggaatccagtgttgtaaggatagaacctaagaatccaccaccacccatcaattttcaggaatgggatggtctagtaaggataacctttgttaggaaaaacaagacactctctgctgcatttaaatcaagtgcagtgcaacaactcttggaaaaaaactacagaattcactgttcagtccataatattataataccagaagatttcagcatagcagataaaatacagcaaatcctaaccagcacaggttttagtgacaaacgggcccgttccatggacatagatgacttcatcagattgctacatggattcaacgcagaaggtattcatttttcctaggtatttggaaaacagaaattttcaaggtcaagaaaagaaatgaattttgtattttttgtatttgagaagataatgcttttgctttactgagacattatttacttgactatttttggttcaatactactactgttgtcaccatttatgattctgaattttaaagttggaaagttctaagtatcaaagtttttaatatataatgctggtccaatctattcataataatcttcaagttcaggagccgcagagacgcacaactttacacttatcatttctaacagtttattgtataaagatgttactcttctatttactgttatatactgtaaggccttctttaggcctttagctctgttcctccagtaataaaaaagttaaaatatgcttcactagtcacacattccccataccatttcgtgttattcacattccccgtaccatttcttgttattcacatgtacagtaaaacaattgtttcttaaattatttttattttggttctctcattctcttccctatttatcctatacagtgtctgttacgattgcctacctctttcgctatcctatagcgtcagagacttagggttctgggtaagcccaagtctgctactgccaccgtgcagtgccaggcatattaaagggcatgactcccaacatgtaaaatgaggaagctaaactggaatgaaattaacaataaaattatctttttttatggttcttagggagataactataggcttagcaaaatttcagagggttttgtaattgaaactggtttcaacttcagaaaaacagccatttcccataactacaggttcccagtattcctatgatttctggacaattaaaatttccagttcctttttcatatacctggtgcttagttttaagctattttaaaactgtcagactgagaatttcaatagatgtcataaactagttttattagctactatgtttaagtcaatataatactaagtgctgttaatatactataatagagttatagtagctattttgtttctataaaaaattaataaaaatatctttattgatatttggctttttttaatacctaacttaatagaagagtgtttccaattaatttaacaaagccagattttgaaatctggcttcaaagtcatagtaaatgttactacataattaaaataatgcttgttcttaatgtataatccagaacaaaggcatcaagctgcttttgttaaacaaatatgaaataatatacattaagagtagatttttttgtttaatttcacaaaactattttgcagagttcacttgtatcatctctatccttatagtaaaaattttaagatttaactcggctttctcaggttatttccctctacccctatgaactgctgagttttagttccttttctggccttcagttttcactatctgtaaagctgaaggactgtattatattacctccagtatcttttctggtactaatttttaaaatacctgatcagaatgaagccatcatagtgtaaggcagcatatttgtctataaggagactttccaaagacagtacccatccaatgcaaataataaatttgaagctaatcatctgttgtgctttaaaatgagcaaattcacatgtctttattgccctttgaaagttggttaatctcaaaaactaccttttttttaaatatcctttgcaaggtcaattgtaacagttctccatccttcctcttccctttgaaataaacacaaatagaatatatcttacagctgcaagaaaacctgagtcctttccaaaac

SEQ ID NO: 369376 - DNA, 2989 bp, Homo sapiens
agcaggaggagctcagagcgtacgggagggggcggacccttgcccctccggcgcttgggccagagtggtgcgggcggcgcgtggcggcgatccccacgtggtggctttctcacgctagccctctttggtcctccttgacgtcccgggcctgtgggcccgctttctgccgagatgccgaaggtcaagtcgggggccatcggccgccgccgcgggcggcaggagcagcgccgggagctgaagagcgctggaggactcatgttcaacacggggattgggcagcacattttgaaaaatcctctcattattaacagcattatcgataaggctgccttaagaccaactgatgtagtgctggaagttggacctggaactggcaacatgactgtaaagttgttagaaaaggcaaaaaaggttgttgcttgtgaacttgacccaaggctagtagctgaacttcacaaaagagttcagggcacgcctgtggccagcaaacttcaagtactggtgggtgatgtgctgaaaacagatttgccattctttgatacttgtgtggcaaatttgccttatcagatctcttcgccttttgtcttcaagctgttgctacatcgaccttttttcaggtttgtgacaaaagactagagttactgccaaattttgaaagacttacagttcaggtggtgaacatagccaaaaatgagtcaggtgtgctatacttatgtttcaaagagaatttgccctccgactggttgcaaaacctggagataagttatactgcagactctcaattaatacacagctgttggcacgtgtggaccatctaatgaaagtgggaaagaataacttcagaccaccgcccaaggtggaatccagtgttgtaaggatagaacctaagaatccaccaccacccatcaattttcaggaatgggatggtctagtaaggataacctttgttaggaaaaacaagacactctctgctgcatttaaatcaagtgcagtgcaacaactcttggaaaaaaactacagaattcactgttcagtccataatattataataccagaagatttcagcatagcagataaaatacagcaaatcctaaccagcacaggttttagtgacaaacgggcccgttccatggacatagatgacttcatcagattgctacatggattcaacgcagaaggtattcatttttcctaggtatttggaaaacagaaattttcaaggtcaagaaaagaaatgaattttgtattttttgtatttgagaagataatgcttttgctttactgagacattatttacttgactatttttggttcaatactactactgttgtcaccatttatgattctgaattttaaagttggaaagttctaagtatcaaagtttttaatatataatgctggtccaatctattcataataatcttcaagttcaggagccgcagagacgcacaactttacacttatcatttctaacagtttattgtataaagatgttactcttctatttactgttatatactgtaaggccttctttaggcctttagctctgttcctccagtaataaaaaagttaaaatatgcttcactagtcacacattccccataccatttcgtgttattcacattccccgtaccatttcttgttattcacatgtacagtaaaacaattgtttcttaaattatttttattttggttctctcattctcttccctatttatcctatacagtgtctgttacgattgcctacctctttcgctatcctatagcgtcagagacttagggttctgggtaagcccaagtctgctactgccaccgtgcagtgccaggcatattaaagggcatgactcccaacatgtaaaatgaggaagctaaactggaatgaaattaacaataaaattatctttttttatggttcttagggagataactataggcttagcaaaatttcagagggttttgtaattgaaactggtttcaacttcagaaaaacagccatttcccataactacaggttcccagtattcctatgatttctggacaattaaaatttccagttcctttttcatatacctggtgcttagttttaagctattttaaaactgtcagactgagaatttcaatagatgtcataaactagttttattagctactatgtttaagtcaatataatactaagtgctgttaatatactataatagagttatagtagctattttgtttctataaaaaattaataaaaatatctttattgatatttggctttttttaatacctaacttaatagaagagtgtttccaattaatttaacaaagccagattttgaaatctggcttcaaagtcatagtaaatgttactacataattaaaataatgcttgttcttaatgtataatccagaacaaaggcatcaagctgcttttgttaaacaaatatgaaataatatacattaagagtagatttttttgtttaatttcacaaaactattttgcagagttcacttgtatcatctctatccttatagtaaaaattttaagatttaactcggctttctcaggttatttccctctacccctatgaactgctgagttttagttccttttctggccttcagttttcactatctgtaaagctgaaggactgtattatattacctccagtatcttttctggtactaatttttaaaatacctgatcagaatgaagccatcatagtgtaaggcagcatatttgtctataaggagactttccaaagacagtacccatccaatgcaaataataaatttgaagctaatcatctgttgtgctttaaaatgagcaaattcacatgtctttattgccctttgaaagttggttaatctcaaaaactaccttttttttaaatatcctttgcaaggtcaattgtaacagttctccatccttcctcttccctttgaaataaacacaaatagaatatatcttacagctgcaagaaaacctgagtcctttccaaaac

SEQ ID NO: 369377 - DNA, 1923 bp, Homo sapiens
agcaggaggagctcagagcgtacgggagggggcggacccttgcccctccggcgcttgggccagagtggtgcgggcggcgcgtggcggcgatccccacgtggtggctttctcacgctagccctctttggtcctccttgacgtcccgggcctgtgggcccgctttctgccgagatgccgaaggtcaagtcgggggccatcggccgccgccgcgggcggcaggagcagcgccgggagctgaagagcgctggaggactcatgttcaacacggggattgggcagcacattttgaaaaatcctctcattattaacagcattatcgataaggctgccttaagaccaactgatgtagtgctggaagttggacctggaactggcaacatgactgtaaagttgttagaaaaggcaaaaaaggttgttgcttgtgaacttgacccaaggctagtagctgaacttcacaaaagagttcagggcacgcctgtggccagcaaacttcaagtactggtgggtgatgtgctgaaaacagatttgccattctttgatacttgtgtggcaaatttgccttatcagatctcttcgccttttgtcttcaagctgttgctacatcgaccttttttcaggtgtgctatacttatgtttcaaagagaatttgccctccgactggttgcaaaacctggagataagttatactgcagactctcaattaatacacagctgttggcacgtgtggaccatctaatgaaagtgggaaagaataacttcagaccaccgcccaaggtggaatccagtgttgtaaggatagaacctaagaatccaccaccacccatcaattttcaggaatgggatggtctagtaaggataacctttgttaggaaaaacaagacactctctgctgcatttaaatcaagtgcagtgcaacaactcttggaaaaaaactacagaattcactgttcagtccataatattataataccagaagatttcagcatagcagataaaatacagcaaatcctaaccagcacaggttttagtgacaaacgggcccgttccatggacatagatgacttcatcagattgctacatggattcaacgcagaaggtattcatttttcctaggtatttggaaaacagaaattttcaaggtcaagaaaagaaatgaattttgtattttttgtatttgagaagataatgcttttgctttactgagacattatttacttgactatttttggttcaatactactactgttgtcaccatttatgattctgaattttaaagttggaaagttctaagtatcaaagtttttaatatataatgctggtccaatctattcataataatcttcaagttcaggagccgcagagacgcacaactttacacttatcatttctaacagtttattgtataaagatgttactcttctatttactgttatatactgtaaggccttctttaggcctttagctctgttcctccagtaataaaaaagttaaaataaaaaaaaaaaaaaaaaaaaacacaacaaaaaaaaaaaaacaaaaacaaacaacaacaaacagcgaacgagaaacggacaagcaagaaaaaaccacggaagaacagaagcaaaacagacaaaagagagacggagagaaagaggagacgaccggagcagcagagagaaagaacaagacagagcacgcgacccacacacgagccagaggaccacgcaaagcagagaccaggcaggcgcgcgacacacaagcgcaagcagagaaacaccaacgcagaactcaacgacgcgcgacaaatgacgccagcgggcgccgcccgcacacacaaacaacacaaaagccccccggacgcggaacgcacagccaatgacgaagaggcaagagacaacccacgcgacaggaccgcgaaacaaagcgacagagacgagccca

SEQ ID NO: 369378 - DNA, 1562 bp, Homo sapiens
agcaggaggagctcagagcgtacgggagggggcggacccttgcccctccggcgcttgggccagagtggtgcgggcggcgcgtggcggcgatccccacgtggtggctttctcacgctagccctctttggtcctccttgacgtcccgggcctgtgggcccgctttctgccgagatgccgaaggtcaagtcgggggccatcggccgccgccgcgggcggcaggagcagcgccgggagctgaagagcgctggaggactcatgttcaacacggggattgggcagcacattttgaaaaatcctctcattattaacagcattatcgataaggctgccttaagaccaactgatgtagtgctggaagttggacctggaactggcaacatgactgtaaagttgttagaaaaggcaaaaaaggttgttgcttgtgaacttgacccaaggctagtagctgaacttcacaaaagagttcagggcacgcctgtggccagcaaacttcaagtactggtgggtgatgtgctgaaaacagatttgccattctttgatacttgtgtggcaaatttgccttatcagatctcttcgccttttgtcttcaagctgttgctacatcgaccttttttcaggtgtgctatacttatgtttcaaagagaatttgccctccgactggttgcaaaacctggagataagttatactgcagactctcaattaatacacagctgttggcacgtgtggaccatctaatgaaagtgggaaagaataacttcagaccaccgcccaaggtggaatccagtgttgtaaggatagaacctaagaatccaccaccacccatcaattttcaggaatgggatggtctagtaaggataacctttgttaggaaaaacaagacactctctgctgcatttaaatcaagtgcagtgcaacaactcttggaaaaaaactacagaattcactgttcagtccataatattataataccagaagatttcagcatagcagataaaatacagcaaatcctaaccagcacaggttttagtgacaaacgggcccgttccatggacatagatgacttcatcagattgctacatggattcaacgcagaaggtattcatttttcctaggtatttggaaaacagaaattttcaaggtcaagaaaagaaatgaattttgtattttttgtatttgagaagataatgcttttgctttactgagacattatttacttgactatttttggttcaatactactactgttgtcaccatttatgattctgaattttaaagttggaaagttctaagtatcaaagtttttaatatataatgctggtccaatctattcataataatcttcaagttcaggagccgcagagacgcacaactttacacttatcatttctaacagtttattgtataaagatgttactcttctatttactgttatatactgtaaggccttctttaggcctttagctctgttcctccagtaataaaaaagttaaaatcccaccccccaatctccacccccacccccccccacgggcctcctccgcctcacgggaggacccctccc

SEQ ID NO: 369379 - DNA, 2271 bp, Homo sapiens
tgagacagagtcttgctctgtcacccaggctggactccagtggcacaatctcagctcactgcaacctccgcctcctgggttcaggcaaatctcctgcctcaaccacccgagtagctgggattacaggcatgtgccaccatgccaggctaatttttgtatttttagtagagacggggtttcaccatgttggccagactgttctcgaactactgacctcaggtaatccacccgcctcagcctcccaaagtgctgggattacaggcataagccactgcgcccagccagtaacgtttctttaataactagtattaggagtgggtgggctctgtaagcatgctgtattcatgttttagtattaatggtatagaactatataccgttatgtgctacaaattagcttttcagtaccattccattttgatttcttttttcagattgctacatggattcaacgcagaaggtattcatttttcctaggtatttggaaaacagaaattttcaaggtcaagaaaagaaatgaattttgtattttttgtatttgagaagataatgcttttgctttactgagacattatttacttgactatttttggttcaatactactactgttgtcaccatttatgattctgaattttaaagttggaaagttctaagtatcaaagtttttaatatataatgctggtccaatctattcataataatcttcaagttcaggagccgcagagacgcacaactttacacttatcatttctaacagtttattgtataaagatgttactcttctatttactgttatatactgtaaggccttctttaggcctttagctctgttcctccagtaataaaaaagttaaaatatgcttcactagtcacacattccccataccatttcgtgttattcacattccccgtaccatttcttgttattcacatgtacagtaaaacaattgtttcttaaattatttttattttggttctctcattctcttccctatttatcctatacagtgtctgttacgattgcctacctctttcgctatcctatagcgtcagagacttagggttctgggtaagcccaagtctgctactgccaccgtgcagtgccaggcatattaaagggcatgactcccaacatgtaaaatgaggaagctaaactggaatgaaattaacaataaaattatctttttttatggttcttagggagataactataggcttagcaaaatttcagagggttttgtaattgaaactggtttcaacttcagaaaaacagccatttcccataactacaggttcccagtattcctatgatttctggacaattaaaatttccagttcctttttcatatacctggtgcttagttttaagctattttaaaactgtcagactgagaatttcaatagatgtcataaactagttttattagctactatgtttaagtcaatataatactaagtgctgttaatatactataatagagttatagtagctattttgtttctataaaaaattaataaaaatatctttattgatatttggctttttttaatacctaacttaatagaagagtgtttccaattaatttaacaaagccagattttgaaatctggcttcaaagtcatagtaaatgttactacataattaaaataatgcttgttcttaatgtataatccagaacaaaggcatcaagctgcttttgttaaacaaatatgaaataatatacattaagagtagatttttttgtttaatttcacaaaactattttgcagagttcacttgtatcatctctatccttatagtaaaaattttaagatttaactcggctttctcaggttatttccctctacccctatgaactgctgagttttagttccttttctggccttcagttttcactatctgtaaagctgaaggactgtattatattacctccagtatcttttctggtactaatttttaaaatacctgatcagaatgaagccatcatagtgtaaggcagcatatttgtctataaggagactttccaaagacagtacccatccaatgcaaataataaatttgaagctaatcatctgttgtgctttaaaatgagcaaattcacatgtctttattgccctttgaaagttggttaatctcaaaaactaccttttttttaaatatcctttgcaaggtcaattgtaacagttctccatccttcctcttccctttgaaataaacacaaatagaatatatcttacagctgcaagaaaacctgagtcctttccaaaac

SEQ ID NO: 369380 - DNA, 874 bp, Homo sapiens
agcaggaggagctcagagcgtacgggagggggcggacccttgcccctccggcgcttgggccagagtggtgcgggcggcgcgtggcggcgatccccacgtggtggctttctcacgctagccctctttggtcctccttgacgtcccgggcctgtgggcccgctttctgccgagatgccgaaggtcaagtcgggggccatcggccgccgccgcgggcggcaggagcagcgccgggagctgaagagcgctggaggactcatgttcaacacggggattgggcagcacattttgaaaaatcctctcattattaacagcattatcgataaggctgccttaagaccaactgatgtagtgctggaagttggacctggaactggcaacatgactgtaaagttgttagaaaaggcaaaaaaggtagaaaggggatttaatgtttggtatcacaaatgactatgttagcaagctcagttggtttacaatctaaatatgttttaactaattgctattattttagtagtaactcctgatcccttgttggaaattttgtcttagaaaatatgagatatttcaccactgcacccggcccatttttgtttgttgtttgaagtatgcgagtataattaaaggaatattgatggtagaaatgggagaagaagtttgtcacataaatcatgtaagagttcctgttgggcgataacatcgatgttatcgcccaacacgcagttggtacctactacagtgtattgtaaacctttttctctgttcttctagggctactacaaagttctgggaaagggtaagctccctaagcagcctgtcatcgtgtaggcctaattcttcagcagaagatgctgaggagatgattatagagtttggt

SEQ ID NO: 369381 - DNA, 358 bp, Homo sapiens
aaaatgtccatttttattcttgttgatctagcatgagattattttgtacattccataagatccttaaaagacaatatataatgtataactagcacaattttgacttgaattctgacaggtcagtgctgctgtgtatcctgtgaaacagatatgagcaactttgattactccaccctgtcctctaactactgacagttgtttttagccataacaagaatcagattcagcagttacaggttcctcaaagctgtagatatgtgtagcttgcacaacttaaaataattgtgtagtttactgtcctctgaattgtgaccacgtcttgtttcttgctcacatagcagttacaaatatagttatt

SEQ ID NO: 369382 - DNA, 420 bp, Homo sapiens
gagaagataatgcttttgctttactgagacattatttacttgactatttttggttcaatactactactgttgtcaccatttatgattctgaattttaaagttggaaagttctaagtatcaaagtttttaatatataatgctggtccaatctattcataataatcttcaagttcaggagccgcagagacgcacaactttacacttatcatttctaacagtttattgtataaagatgttactcttctatttactgttatatactgtaaggccttctttaggcctttagctctgttcctccagtaataaaaaagttaaaatatgcttcactagtcacacattccccataccatttcgtgttattcacattccccgtaccatttcttgttattcacatgtacagtaaaacaattgtttcttaaa

SEQ ID NO: 369383 - DNA, 2907 bp, Homo sapiens
agcaggaggagctcagagcgtacgggagggggcggacccttgcccctccggcgcttgggccagagtggtgcgggcggcgcgtggcggcgatccccacgtggtggctttctcacgctagccctctttggtcctccttgacgtcccgggcctgtgggcccgctttctgccgagatgccgaaggtcaagtcgggggccatcggccgccgccgcgggcggcaggagcagcgccgggagctgaagagcgctggaggactcatgttcaacacggggattgggcagcacattttgaaaaatcctctcattattaacagcattatcgataaggctgccttaagaccaactgatgtagtgctggaagttggacctggaactggcaacatgactgtaaagttgttagaaaaggcaaaaaaggttgttgcttgtgaacttgacccaaggctagtagctgaacttcacaaaagagttcagggcacgcctgtggccagcaaacttcaagtactggtgggtgatgtgctgaaaacagatttgccattctttgatacttgtgtggcaaatttgccttatcagatctcttcgccttttgtcttcaagctgttgctacatcgaccttttttcaggtgtgctatacttatgtttcaaagagaatttgccctccgactggttgcaaaacctggagataagttatactgcagactctcaattaatacacagctgttggcacgtgtggaccatctaatgaaagtgggaaagaataacttcagaccaccgcccaaggtggaatccagtgttgtaaggatagaacctaagaatccaccaccacccatcaattttcaggaatgggatggtctagtaaggataacctttgttaggaaaaacaagacactctctgctgcatttaaatcaagtgcagtgcaacaactcttggaaaaaaactacagaattcactgttcagtccataatattataataccagaagatttcagcatagcagataaaatacagcaaatcctaaccagcacaggttttagtgacaaacgggcccgttccatggacatagatgacttcatcagattgctacatggattcaacgcagaaggtattcatttttcctaggtatttggaaaacagaaattttcaaggtcaagaaaagaaatgaattttgtattttttgtatttgagaagataatgcttttgctttactgagacattatttacttgactatttttggttcaatactactactgttgtcaccatttatgattctgaattttaaagttggaaagttctaagtatcaaagtttttaatatataatgctggtccaatctattcataataatcttcaagttcaggagccgcagagacgcacaactttacacttatcatttctaacagtttattgtataaagatgttactcttctatttactgttatatactgtaaggccttctttaggcctttagctctgttcctccagtaataaaaaagttaaaatatgcttcactagtcacacattccccataccatttcgtgttattcacattccccgtaccatttcttgttattcacatgtacagtaaaacaattgtttcttaaattatttttattttggttctctcattctcttccctatttatcctatacagtgtctgttacgattgcctacctctttcgctatcctatagcgtcagagacttagggttctgggtaagcccaagtctgctactgccaccgtgcagtgccaggcatattaaagggcatgactcccaacatgtaaaatgaggaagctaaactggaatgaaattaacaataaaattatctttttttatggttcttagggagataactataggcttagcaaaatttcagagggttttgtaattgaaactggtttcaacttcagaaaaacagccatttcccataactacaggttcccagtattcctatgatttctggacaattaaaatttccagttcctttttcatatacctggtgcttagttttaagctattttaaaactgtcagactgagaatttcaatagatgtcataaactagttttattagctactatgtttaagtcaatataatactaagtgctgttaatatactataatagagttatagtagctattttgtttctataaaaaattaataaaaatatctttattgatatttggctttttttaatacctaacttaatagaagagtgtttccaattaatttaacaaagccagattttgaaatctggcttcaaagtcatagtaaatgttactacataattaaaataatgcttgttcttaatgtataatccagaacaaaggcatcaagctgcttttgttaaacaaatatgaaataatatacattaagagtagatttttttgtttaatttcacaaaactattttgcagagttcacttgtatcatctctatccttatagtaaaaattttaagatttaactcggctttctcaggttatttccctctacccctatgaactgctgagttttagttccttttctggccttcagttttcactatctgtaaagctgaaggactgtattatattacctccagtatcttttctggtactaatttttaaaatacctgatcagaatgaagccatcatagtgtaaggcagcatatttgtctataaggagactttccaaagacagtacccatccaatgcaaataataaatttgaagctaatcatctgttgtgctttaaaatgagcaaattcacatgtctttattgccctttgaaagttggttaatctcaaaaactaccttttttttaaatatcctttgcaaggtcaattgtaacagttctccatccttcctcttccctttgaaataaacacaaatagaatatatcttacagctgcaagaaaacctgagtcctttccaaaac

SEQ ID NO: 369384 - DNA, 2006 bp, Homo sapiens
agcaggaggagctcagagcgtacgggagggggcggacccttgcccctccggcgcttgggccagagtggtgcgggcggcgcgtggcggcgatccccacgtggtggctttctcacgctagccctctttggtcctccttgacgtcccgggcctgtgggcccgctttctgccgagatgccgaaggtcaagtcgggggccatcggccgccgccgcgggcggcaggagcagcgccgggagctgaagagcgctggaggactcatgttcaacacggggattgggcagcacattttgaaaaatcctctcattattaacagcattatcgataaggctgccttaagaccaactgatgtagtgctggaagttggacctggaactggcaacatgactgtaaagttgttagaaaaggcaaaaaaggttgttgcttgtgaacttgacccaaggctagtagctgaacttcacaaaagagttcagggcacgcctgtggccagcaaacttcaagtactggtgggtgatgtgctgaaaacagatttgccattctttgatacttgtgtggcaaatttgccttatcagatctcttcgccttttgtcttcaagctgttgctacatcgaccttttttcaggtgtgctatacttatgtttcaaagagaatttgccctccgactggttgcaaaacctggagataagttatactgcagactctcaattaatacacagctgttggcacgtgtggaccatctaatgaaagtgggaaagaataacttcagaccaccgcccaaggtggaatccagtgttgtaaggatagaacctaagaatccaccaccacccatcaattttcaggaatgggatggtctagtaaggataacctttgttaggaaaaacaagacactctctgctgcatttaaatcaagtgcagtgcaacaactcttggaaaaaaactacagaattcactgttcagtccataatattataataccagaagatttcagcatagcagataaaatacagcaaatcctaaccagcacaggttttagtgacaaacgggcccgttccatggacatagatgacttcatcagattgctacatggattcaacgcagaaggtattcatttttcctaggtatttggaaaacagaaattttcaaggtcaagaaaagaaatgaattttgtattttttgtatttgagaagataatgcttttgctttactgagacattatttacttgactatttttggttcaatactactactgttgtcaccatttatgattctgaattttaaagttggaaagttctaagtatcaaagtttttaatatataatgctggtccaatctattcataataatcttcaagttcaggagccgcagagacgcacaactttacacttatcatttctaacagtttattgtataaagatgttactcttctatttactgttatatactgtaaggccttctttaggcctttagctctgttcctccagtaataaaaaagttaaaatatgcttcactagtcacacattccccataccatttcgtgttattcacattccccgtaccatttcttgttattcacatgtacagtaaaacaattgtttcttaaattatttttattttggttctctcattctcttccctatttatcctatacagtgtctgttacgattgcctacctctttcgctatcctatagcgtcagagacttagggttctgggtaagcccaagtctgctactgccaccgtgcagtgccaggcatattaaagggcatgactcccaacatgtaaaatgaggaagctaaactggaatgaaattaacaataaaattatctttttttatggttcttagggagataactataaaaaaattagctgggcgtggtgacgggcgcctgtaatcccagctactcgggaggctgaggcaggagaatcgcttgaaccccggagtcagaggctgcagtgagctgagattgtgccactgcactccagcctgggtgacatagcaagactccatctta

SEQ ID NO: 369385 - DNA, 2869 bp, Homo sapiens
agcaggaggagctcagagcgtacgggagggggcggacccttgcccctccggcgcttgggccagagtggtgcgggcggcgcgtggcggcgatccccacgtggtggctttctcacgctagccctctttggtcctccttgacgtcccgggcctgtgggcccgctttctgccgagatgccgaaggtcaagtcgggggccatcggccgccgccgcgggcggcaggagcagcgccgggagctgaagagcgctggaggactcatgttcaacacggggattgggcagcacattttgaaaaatcctctcattattaacagcattatcgataaggctgccttaagaccaactgatgtagtgctggaagttggacctggaactggcaacatgactgtaaagttgttagaaaaggcaaaaaaggttgttgcttgtgaacttgacccaaggctagtagctgaacttcacaaaagagttcagggcacgcctgtggccagcaaacttcaagtactggtgggtgatgtgctgaaaacagatttgccattctttgatacttgtgtggcaaatttgccttatcagatctcttcgccttttgtcttcaagctgttgctacatcgaccttttttcaggtgtgctatacttatgtttcaaagagaatttgccctccgactggttgcaaaacctggagataagttatactgcagactctcaattagtgggaaagaataacttcagaccaccgcccaaggtggaatccagtgttgtaaggatagaacctaagaatccaccaccacccatcaattttcaggaatgggatggtctagtaaggataacctttgttaggaaaaacaagacactctctgctgcatttaaatcaagtgcagtgcaacaactcttggaaaaaaactacagaattcactgttcagtccataatattataataccagaagatttcagcatagcagataaaatacagcaaatcctaaccagcacaggttttagtgacaaacgggcccgttccatggacatagatgacttcatcagattgctacatggattcaacgcagaaggtattcatttttcctaggtatttggaaaacagaaattttcaaggtcaagaaaagaaatgaattttgtattttttgtatttgagaagataatgcttttgctttactgagacattatttacttgactatttttggttcaatactactactgttgtcaccatttatgattctgaattttaaagttggaaagttctaagtatcaaagtttttaatatataatgctggtccaatctattcataataatcttcaagttcaggagccgcagagacgcacaactttacacttatcatttctaacagtttattgtataaagatgttactcttctatttactgttatatactgtaaggccttctttaggcctttagctctgttcctccagtaataaaaaagttaaaatatgcttcactagtcacacattccccataccatttcgtgttattcacattccccgtaccatttcttgttattcacatgtacagtaaaacaattgtttcttaaattatttttattttggttctctcattctcttccctatttatcctatacagtgtctgttacgattgcctacctctttcgctatcctatagcgtcagagacttagggttctgggtaagcccaagtctgctactgccaccgtgcagtgccaggcatattaaagggcatgactcccaacatgtaaaatgaggaagctaaactggaatgaaattaacaataaaattatctttttttatggttcttagggagataactataggcttagcaaaatttcagagggttttgtaattgaaactggtttcaacttcagaaaaacagccatttcccataactacaggttcccagtattcctatgatttctggacaattaaaatttccagttcctttttcatatacctggtgcttagttttaagctattttaaaactgtcagactgagaatttcaatagatgtcataaactagttttattagctactatgtttaagtcaatataatactaagtgctgttaatatactataatagagttatagtagctattttgtttctataaaaaattaataaaaatatctttattgatatttggctttttttaatacctaacttaatagaagagtgtttccaattaatttaacaaagccagattttgaaatctggcttcaaagtcatagtaaatgttactacataattaaaataatgcttgttcttaatgtataatccagaacaaaggcatcaagctgcttttgttaaacaaatatgaaataatatacattaagagtagatttttttgtttaatttcacaaaactattttgcagagttcacttgtatcatctctatccttatagtaaaaattttaagatttaactcggctttctcaggttatttccctctacccctatgaactgctgagttttagttccttttctggccttcagttttcactatctgtaaagctgaaggactgtattatattacctccagtatcttttctggtactaatttttaaaatacctgatcagaatgaagccatcatagtgtaaggcagcatatttgtctataaggagactttccaaagacagtacccatccaatgcaaataataaatttgaagctaatcatctgttgtgctttaaaatgagcaaattcacatgtctttattgccctttgaaagttggttaatctcaaaaactaccttttttttaaatatcctttgcaaggtcaattgtaacagttctccatccttcctcttccctttgaaataaacacaaatagaatatatcttacagctgcaagaaaacctgagtcctttccaaaac

SEQ ID NO: 369386 - DNA, 846 bp, Homo sapiens
agcaggaggagctcagagcgtacgggagggggcggacccttgcccctccggcgcttgggccagagtggtgcgggcggcgcgtggcggcgatccccacgtggtggctttctcacgctagccctctttggtcctccttgacgtcccgggcctgtgggcccgctttctgccgagatgccgaaggtcaagtcgggggccatcggccgccgccgcgggcggcaggagcagcgccgggagctgaagagcgctggaggactcatgttcaacacggggattgggcagcacattttgaaaaatcctctcattattaacagcattatcgataaggctgccttaagaccaactgatgtagtgctggaagttggacctggaactggcaacatgactgtaaagttgttagaaaaggcaaaaaaggtagaaaggggatttaatgtttggtatcacaaatgactatgttagcaagctcagttggtttacaatctaaatatgttttaactaattgctattattttagtagtaactcctgatcccttgttggaaattttgtcttagaaaatatgagatatttcagccaggcgcggtggctcacgcctgtaatcccagcactttgggaggccgaggcaggtggatcatgaggtcaagagattgagaccatcctgggcaatatggtgaagccccatctcgactgaaaatacaaaaattagccgagtgtggtggcaggtgcctgtagtcccagctacttgggaggctggggcaggagaatcacttgaacccggaaggcagaggttgcagtgagccaggattgcaccactgcactccagcctggtgacagagtgagactctgtctca

SEQ ID NO: 369387 - DNA, 1369 bp, Homo sapiens
  misc_feature (22)..(22): n is a, c, g, or t
tctgtctcaaaaaaaaaaaaanataaataataataataatacttttcttacacacgtaagaaagactgctggtctcgaacttctcggctcaagctatctatctgcctcagtctcccaaactgctgggattagtcatgagccaccgtgcctggctgtgacccattttagatgacaaaaactaattttcaatgctaatacgaattggttgttaaaggtgaatataattaaactgaacattattggcatcctaaatcctttattggccataatttacctttggattctattcaaactacactttgatctgtagaacccaaattggttactatatgaacttgcatcttcctaaactcatcatgttaaaaattttcacagcttgaaaaatggaggtcctcatatcagtctcttgattttcttttgaggtaagctgtccctctgtgcttagtccttgactaaaaataatcgtactgcttatggtcttgatttgacttttctgtatactggttacactggctcaaaagtccatttttgtggagactcttaaaaagtagtagtcttccacattcaagtactgtacttgaaaaaaaaaaacctggatttcagctttcatttagaaatgctttccctgtaattactacttttaaaacccatattttatatgtcaatttttacattaattaccccattgatagcagtttttgaatggttttagttaaaactgtcaatcttctttgcttgaatctagcctctcattaagtttatcaaaaactttaaaaagtaaatgtaagactcttcatatagtgttttttttttaattgagttatggattctttggatttattcattatctgagttagttttttcagaaatgtcttcttattttgtaggtctgtggttgatgaaaacctgttcatgagggcacaaaagactcttccagtttattctatcactataaaatagaatttgatggatttcgaagtaagaaaattcttagaatagaaaataggatggtaaatctttaaatacatatgagtaattagaatatcataaggctagtacagataatattcttacaaaggcatccataaatagtgaagtggtagcacctattcccccatgattgacattcattaattaatccattgtacccagagttttaagatgaacagcttataagtaccttcttcccctcatgagtaatcactcctcagtgaacatactatatgcttattgccatttgaatatccttttctgttcaagtgtatcatcctttttaaaaattgagttgtcatggaagaatttgatgtaggtaagtgactatcagctgtgaggaaggtagaggaaggcaagaactatcctgaggacagag

SEQ ID NO: 369388 - DNA, 1315 bp, Homo sapiens
  misc_feature (22)..(22): n is a, c, g, or t
tctgtctcaaaaaaaaaaaaanataaataataataataatacttttcttacacacgtaagaaagactgctggtctcgaacttctcggctcaagctatctatctgcctcagtctcccaaactgctgggattagtcatgagccaccgtgcctggctgtgacccattttagatgacaaaaactaattttcaatgctaatacgaattggttgttaaaggtgaatataattaaactgaacattattggcatcctaaatcctttattggccataatttacctttggattctattcaaactacactttgatctgtagaacccaaattggttactatatgaacttgcatcttcctaaactcatcatgttaaaaattttcacagcttgaaaaatggaggtcctcatatcagtctcttgattttcttttgaggtaagctgtccctctgtgcttagtccttgactaaaaataatcgtactgcttatggtcttgatttgacttttctgtatactggttacactggctcaaaagtccatttttgtggagactcttaaaaagtagtagtcttccacattcaagtactgtacttgaaaaaaaaaaacctggatttcagctttcatttagaaatgctttccctgtaattactacttttaaaacccatattttatatgtcaatttttacattaattaccccattgatagcagtttttgaatggttttagttaaaactgtcaatcttctttgcttgaatctagcctctcattaagtttatcaaaaactttaaaaagtaaatgtaagactcttcatatagtgttttttttttaattgagttatggattctttggatttattcattatctgagttagttttttcagaaatgtcttcttattttgtaggtctgtggttgatgaaaacctgttcatgagggcacaaaagactcttccagtttattctatcactataaaatagaatttgatggatttcgaagtaagaaaattcttagaatagtagtacagataatattcttacaaaggcatccataaatagtgaagtggtagcacctattcccccatgattgacattcattaattaatccattgtacccagagttttaagatgaacagcttataagtaccttcttcccctcatgagtaatcactcctcagtgaacatactatatgcttattgccatttgaatatccttttctgttcaagtgtatcatcctttttaaaaattgagttgtcatggaagaatttgatgtaggtaagtgactatcagctgtgaggaaggtagaggaaggcaagaactatcctgaggacagag

SEQ ID NO: 369389 - DNA, 337 bp, Homo sapiens
acaccccatccctaaataataataaaactaccagtctggatggtgcctccctagcacatgggaatgttagtaataatgacccttattccaaaaggtgaccgggaaactttagacccttttactgaacttgcaaagcctcagtcattcacagcatgtttccttgcgttcttcggcatgtgtgcatttctgactgctgttgaagttttgtcttaatctggtgacagcaacatttgttagaagggagaatctcttgagcctgggaggcggaggttacagtgagcccagatcatgcctcttcactccagcctttgctacagagcgagactctgtctcaaaa

SEQ ID NO: 369390 - DNA, 558 bp, Homo sapiens
gagtattatagagataagtaattgtattattttcagacaaaagtatatgtagtaatgtaaactactgaccagattttgtttcaaattgttttttttaaatgaattgctaagaattatttgaaattagcacattagcggtaataagatagtagatattagatagattagattaggatagtaggtagtagatgtaggtataaagagactgaaaatcagctgtttaaacatttttcccaaatgtggggctaggaagcaagataaagaattatgcaggccaggcgcggtggctcacgcctgtaatcccagcactttgggaggccgaggcgggcggatcatgaagtcaggagatcgagaccatcctggccaacacggtgaaaccccgtctctactaaaaatacaaaaaaaattagccgggcgtggtggcgggtgcctgtagtcccagctacacgggaggctgaggcaggagaatagggtgaacccaggaggtggagcttgcagtgagccgagatcgcgccactgcactccagcctgggcaacagagcgagactccgtctcaaa

SEQ ID NO: 369391 - DNA, 4827 bp, Homo sapiens
caagcttatgcatgcggccgctgaatggaggccaacatgccgaagcggaaggagcccggcaggtctctccgcatcaaagtcatctccatgggcaacgccgaagtggggaaaagctgtattataaagcgatactgtgagaaaagattcgtgtctaaatacctggcaacaattggaattgactatggagtcacaaaggtacacgtcagagacagagaaatcaaagttaacatctttgatatggctggacatcccttcttctatgaggttcgaaatgagttttacaaggacacacagggtgtgatactggtctatgatgttgggcagaaagactcctttgacgcccttgatgcgtggctggcagaaatgaagcaagagcttggacctcatggaaacatggaaaatattatatttgtagtttgtgccaacaagattgattgtaccaaacatcgctgtgtagatgaaagtgaaggacgtctttgggctgaaagcaaagggttcctgtactttgaaacttcagcacaaactggagaaggcattaatgagatgttccagaccttttatatatccatagttgatttatgtgaaaatggcgggaaacgccctaccaccaatagcagtgctagtttcaccaaagaacaagcagatgccattcgcagaattcgaaatagtaaagacagttgggacatgctgggagtcaaacctggggcctcaagggatgaagtcaataaagcgtatcggaaacttgctgtgcttcttcaccctgacaaatgtgtagcacctggcagtgaagatgccttcaaagcagttgtgaatgctcggacagccctcctgaaaaacatcaagtagaaagtacagaaaaaagccacatgtgggactcaaatgcaaacagactttccctagaggtgaaataaccaacgtggagttttccttcccagaatctcactgctcttttcattcatgtgttgtcatttgtatatcagtaattcaggtacccatttcatagacattttactgagaaatgacctgcatttgtatgaagtgaactgagcgtcacaccctgtacttcatttcatatttctagataattctgaatttttttctcattcgtcagctctgtaattatagtatcacttagacatttcacttggggaaatccacaaggttcctggaggagggaagagaggacaagaggaccctttcactttttcttttttacggaattcatcatcagagaagaaaataacaaaaatggaagcaaacaacatcagaacccctgtaagtttggtgtgaccttacagacaagttgctgcttttacaatgagttccttaggtggtattttaacccatcgatctataatgatgactcttggcagccctttgggagtttgtaaaatgaggtgatacagttctgaattgagcattcctttatgatattcactctgttcctcttctgcagccaccagtgggagagacaagccagtcctaagagaaaaggtggtggcagccacaaattctaggtacactggctgctgcctatcctgtccctggatctgaggcctttcccttgccatagaaatggttgctggtagcagtagagagcactgtgcacctgggaatgaggaatcaggccccaagacagaagtacttggaggagccagctgcagtagtatccgcctgtagtcccagctactcaggaggctgagacaggaggattgcttaagcccaggagctcaagtcccacctgggcaacatagtaagatcttgtctcttaaaaaaaaaaaaaaaggtacttagaggtcgcacttaaagattatgcacatcagcagaggaaaggccagccaagcttggggcaagcttgatgcagtaggagagactccttatgaggcttagcccttgtcttactgccagcctttgccacaggcaggtgagaaaggcagggccactcctcagcaaagttggcctcttctacacttcctcaccagtgttgtttcttccttttttcccctcttccccttcccgtcttgtgttttttctgaaccccacatctgccatcatttctctcctctagagtccctggcttctggccactgcctcctccctcttctaagccttggcctgaatctggttgatcagaggcaagtgtggatcctttgggtggcagtcaggggagatctcagggcctctgttgggaggaatctctgtaattcctgcttgggctccaaatttctgaagagtaatatttttaaactatagcttacaaaatacattctctgaccacagtctcctccttgatatacaagggatggatgaagttcatgtattaggactggcactccttacggtgcttatagaactagtctcaccacttgactcattacgtcgtcattcttgttacatcactcatacttttagctgcaaccacactaattcacatttttatatactttcaattagctgtactaattggggcttgaaagtatataaaatcttcctgtcctgtgaattttaaaaagctatcccatatcgattgccaaagagcatctaccttacctcctaagaagaaaagccactttcttccaatccaagcccactgcagccttgtggattttccacacagcagcttttcactgtatgcctgtacttgggctgcactgagcttgtcttcaggaaaccagagcgttgctttatcatcgcacttttcatcttggtaatatcaaaacaactttttaaatgaactgattgatatatgttatttcttgcgaggttttcctctggcctttaactggcttctgaggctacagaactccaacccagagttcttcgggacctaaattttgcttaaggaaggcctttatcatgctgaaagcactcagacatgtctgtcctcacagcagaatgtagaagtcatatgaatgagggatcgtgcacggtagcgtcagcccgaattgacacgacaactctgaatgtgtggccctctatgaaagctggtgccagttttcatcactgttattaaatactagattgggaacctcattcagccgtattgcacagatgagcaattacagcagagaaaattcattagtgctcccactcatatccttatgtgtgagttggtgaaatttagcctgagcttgattcttaggtcttgagactcagtttccaacaccttcattattaatgttaagaatggccatataccacttcatttacgtaaaaggaataaaataagcaagttaagcttcagggtcctagaatttttctgatttctataatccttcagcagaatattaagaaataaagcatgatctgcaatggaaaggtttttttggcactaacttcatgcagaatttcacagacatctatgcattaatttaaattcttggtgcaaatgtgtgctttgtagttcaaccttattaaaaattcttcagccagttaggatttcaaaatacattagtgagagtaacagctagcagaataattacaatggctaaaacgtttttatagagaatcttgtttttcaaaaaagaataaaaagtttgaatagctattattaaagaaaagccatgtcttcaacatctgagtcaccaagaagtaacactttttaaacttgttagaaatccctggaggcatttcaaattcatcttctaacctacctaagcactttaaaatacagcctccttctgttcctctgttccccttcatgcctccttttgaattgatatctcagctgtcaatatttctttgacttcagcattgttattttatttctctatatcaatgtgtccttagttttcttagcctgttaatttaaaaatccagacttgggggtcattgtgttgctacccaagagaaaatgctacagttttatagattgcacatcattctttaaggcatacttttacctcaggaaacttactctagtatgttctcatatattgaattctcaactaagtaactatttctttatacctataaactagtacctaattcactgttagttaaatgagctatagataaggcagctaaatttctgaaagatagccagagtaagtaagcagccactgcaagctctgaatcagttttttaaaaaaaagaaaaaaaaaaaaaaggagctgtgccccattgaacaatgacaacatcacaaggggaagggagggattttgccaaaagttagaaaggtggagctgtaagccatgtgcttgttgcctttgacagtgacagtgcgcgtcttacaactaattccactaggcatgggaatgtcacctcctttgccactgtaccccatcaagcttactctgaatcaaaggttttgtaaaacttttgaaaatgaacttagctgcaaaatatagctaaccactttccattgcaagctttgcaaagtgaagagaggttcgtacttctcataattggtatttagcacaattgtaagatacagttttactgtttgtacatcgtttttttccattaaacttttctagagaagacaaaagcttacactggtgacatggataagtgagatggtgtctaacgagcagtgcaatattaggcggtgcaatagaggccctgttggcaagatgagttttgctggagagctggacagtgttggttagcttcctgcattgattgcccctgggcgttcttcccccttaactgtgaaagcagagtctataaatgaactctttgctcttacaaggtaatttacatattttctttctgttgaaataactgaaaatgttaaatctaccagtttatgtcttgtaaacagagtgtcatatgtatttaagttgtgtatttttataaagtaaagccaagtatcaaacaaaaaaa

SEQ ID NO: 369392 - DNA, 4998 bp, Homo sapiens
agcgggtctccctcccccggctccccacgctcccaaccgcccgcgcctgctgccaggcagcggcggggatggcgagcagcggaggcgaggcggtgacgagagcagcggctccgccattggacgaggaggcctgagggacgggccagcggtgcacaagaagagaccgaggcgggtggccccgagagagccagggccatggaggccaacatgccgaagcggaaggagcccggcaggtctctccgcatcaaagtcatctccatgggcaacgccgaagtggggaaaagctgtattataaagcgatactgtgagaaaagattcgtgtctaaatacctggcaacaattggaattgactatggagtcacaaaggtacacgtcagagacagagaaatcaaagttaacatctttgatatggctggacatcccttcttctatgaggttcgaaatgagttttacaaggacacacagggtgtgatactggtctatgatgttgggcagaaagactcctttgacgcccttgatgcgtggctggcagaaatgaagcaagagcttggacctcatggaaacatggaaaatattatatttgtagtttgtgccaacaagattgattgtaccaaacatcgctgtgtagatgaaagtgaaggacgtctttgggctgaaagcaaagggttcctgtactttgaaacttcagcacaaactggagaaggcattaatgagatgttccagaccttttatatatccatagttgatttatgtgaaaatggcgggaaacgccctaccaccaatagcagtgctagtttcaccaaagaacaagcagatgccattcgcagaattcgaaatagtaaagacagttgggacatgctgggagtcaaacctggggcctcaagggatgaagtcaataaagcgtatcggaaacttgctgtgcttcttcaccctgacaaatgtgtagcacctggcagtgaagatgccttcaaagcagttgtgaatgctcggacagccctcctgaaaaacatcaagtagaaagtacagaaaaaagccacatgtgggactcaaatgcaaacagactttccctagaggtgaaataaccaacgtggagttttccttcccagaatctcactgctcttttcattcatgtgttgtcatttgtatatcagtaattcaggtacccatttcatagacattttactgagaaatgacctgcatttgtatgaagtgaactgagcgtcacaccctgtacttcatttcatatttctagataattctgaatttttttctcattcgtcagctctgtaattatagtatcacttagacatttcacttggggaaatccacaaggttcctggaggagggaagagaggacaagaggaccctttcactttttcttttttacggaattcatcatcagagaagaaaataacaaaaatggaagcaaacaacatcagaacccctgtaagtttggtgtgaccttacagacaagttgctgcttttacaatgagttccttaggtggtattttaacccatcgatctataatgatgactcttggcagccctttgggagtttgtaaaatgaggtgatacagttctgaattgagcattcctttatgatattcactctgttcctcttctgcagccaccagtgggagagacaagccagtcctaagagaaaaggtggtggcagccacaaattctaggtacactggctgctgcctatcctgtccctggatctgaggcctttcccttgccatagaaatggttgctggtagcagtagagagcactgtgcacctgggaatgaggaatcaggccccaagacagaagtacttggaggagccagctgcagtagtatccgcctgtagtcccagctactcaggaggctgagacaggaggattgcttaagcccaggagctcaagtcccacctgggcaacatagtaagatcttgtctcttaaaaaaaaaaaaaaaggtacttagaggtcgcacttaaagattatgcacatcagcagaggaaaggccagccaagcttggggcaagcttgatgcagtaggagagactccttatgaggcttagcccttgtcttactgccagcctttgccacaggcaggtgagaaaggcagggccactcctcagcaaagttggcctcttctacacttcctcaccagtgttgtttcttccttttttcccctcttccccttcccgtcttgtgttttttctgaaccccacatctgccatcatttctctcctctagagtccctggcttctggccactgcctcctccctcttctaagccttggcctgaatctggttgatcagaggcaagtgtggatcctttgggtggcagtcaggggagatctcagggcctctgttgggaggaatctctgtaattcctgcttgggctccaaatttctgaagagtaatatttttaaactatagcttacaaaatacattctctgaccacagtctcctccttgatatacaagggatggatgaagttcatgtattaggactggcactccttacggtgcttatagaactagtctcaccacttgactcattacgtcgtcattcttgttacatcactcatacttttagctgcaaccacactaattcacatttttatatactttcaattagctgtactaattggggcttgaaagtatataaaatcttcctgtcctgtgaattttaaaaagctatcccatatcgattgccaaagagcatctaccttacctcctaagaagaaaagccactttcttccaatccaagcccactgcagccttgtggattttccacacagcagcttttcactgtatgcctgtacttgggctgcactgagcttgtcttcaggaaaccagagcgttgctttatcatcgcacttttcatcttggtaatatcaaaacaactttttaaatgaactgattgatatatgttatttcttgcgaggttttcctctggcctttaactggcttctgaggctacagaactccaacccagagttcttcgggacctaaattttgcttaaggaaggcctttatcatgctgaaagcactcagacatgtctgtcctcacagcagaatgtagaagtcatatgaatgagggatcgtgcacggtagcgtcagcccgaattgacacgacaactctgaatgtgtggccctctatgaaagctggtgccagttttcatcactgttattaaatactagattgggaacctcattcagccgtattgcacagatgagcaattacagcagagaaaattcattagtgctcccactcatatccttatgtgtgagttggtgaaatttagcctgagcttgattcttaggtcttgagactcagtttccaacaccttcattattaatgttaagaatggccatataccacttcatttacgtaaaaggaataaaataagcaagttaagcttcagggtcctagaatttttctgatttctataatccttcagcagaatattaagaaataaagcatgatctgcaatggaaaggtttttttggcactaacttcatgcagaatttcacagacatctatgcattaatttaaattcttggtgcaaatgtgtgctttgtagttcaaccttattaaaaattcttcagccagttaggatttcaaaatacattagtgagagtaacagctagcagaataattacaatggctaaaacgtttttatagagaatcttgtttttcaaaaaagaataaaaagtttgaatagctattattaaagaaaagccatgtcttcaacatctgagtcaccaagaagtaacactttttaaacttgttagaaatccctggaggcatttcaaattcatcttctaacctacctaagcactttaaaatacagcctccttctgttcctctgttccccttcatgcctccttttgaattgatatctcagctgtcaatatttctttgacttcagcattgttattttatttctctatatcaatgtgtccttagttttcttagcctgttaatttaaaaatccagacttgggggtcattgtgttgctacccaagagaaaatgctacagttttatagattgcacatcattctttaaggcatacttttacctcaggaaacttactctagtatgttctcatatattgaattctcaactaagtaactatttctttatacctataaactagtacctaattcactgttagttaaatgagctatagataaggcagctaaatttctgaaagatagccagagtaagtaagcagccactgcaagctctgaatcagttttttaaaaaaaagaaaaaaaaaaaaaaggagctgtgccccattgaacaatgacaacatcacaaggggaagggagggattttgccaaaagttagaaaggtggagctgtaagccatgtgcttgttgcctttgacagtgacagtgcgcgtcttacaactaattccactaggcatgggaatgtcacctcctttgccactgtaccccatcaagcttactctgaatcaaaggttttgtaaaacttttgaaaatgaacttagctgcaaaatatagctaaccactttccattgcaagctttgcaaagtgaagagaggttcgtacttctcataattggtatttagcacaattgtaagatacagttttactgtttgtacatcgtttttttccattaaacttttctagagaagacaaaagcttacactggtgacatggataagtgagatggtgtctaacgagcagtgcaatattaggcggtgcaatagaggccctgttggcaagatgagttttgctggagagctggacagtgttggttagcttcctgcattgattgcccctgggcgttcttcccccttaactgtgaaagcagagtctataaatgaactctttgctcttacaaggtaatttacatattttctttctgttgaaataactgaaaatgttaaatctaccagtttatgtcttgtaaacagagtgtcatatgtatttaagttgtgtatttttataaagtaaagccaagtatcaaacaaaaaaa

SEQ ID NO: 369393 - DNA, 4783 bp, Homo sapiens
gctcagactccagctctctgtgatgtggtcaggaaatggactccaagcagacaaccaggtgattggggggcttatctctcagggagccgtcttgcacttgctgttgtccactgccaacagtttttttccagttcgatagtagttgatggcaggaagtctagtccagtattcattactctgtcatggctggaactcagacatgaaatttaaacaggctttggtctcaatcctagtattctatagcctacactatgacttgtctcctataaccatgtgtgtgatgaatgaatccttgtgccctcagaaatctatgaatattcatatttcaggttaactcgtaggctagaagacagtcttactgatacacaactagcaaacatccgtgaactgtgatcccttttatgtggcttttatctttttagatacatcttggatagaactaatggataaattagtctgtttaaaaaaaaaaagctaacaagaagagaataattacagtattctataaaccttttatatatccatagttgatttatgtgaaaatggcgggaaacgccctaccaccaatagcagtgctagtttcaccaaagaacaagcagatgccattcgcagaattcgaaatagtaaagacagttgggacatgctgggagtcaaacctggggcctcaagggatgaagtcaataaagcgtatcggaaacttgctgtgcttcttcaccctgacaaatgtgtagcacctggcagtgaagatgccttcaaagcagttgtgaatgctcggacagccctcctgaaaaacatcaagtagaaagtacagaaaaaagccacatgtgggactcaaatgcaaacagactttccctagaggtgaaataaccaacgtggagttttccttcccagaatctcactgctcttttcattcatgtgttgtcatttgtatatcagtaattcaggtacccatttcatagacattttactgagaaatgacctgcatttgtatgaagtgaactgagcgtcacaccctgtacttcatttcatatttctagataattctgaatttttttctcattcgtcagctctgtaattatagtatcacttagacatttcacttggggaaatccacaaggttcctggaggagggaagagaggacaagaggaccctttcactttttcttttttacggaattcatcatcagagaagaaaataacaaaaatggaagcaaacaacatcagaacccctgtaagtttggtgtgaccttacagacaagttgctgcttttacaatgagttccttaggtggtattttaacccatcgatctataatgatgactcttggcagccctttgggagtttgtaaaatgaggtgatacagttctgaattgagcattcctttatgatattcactctgttcctcttctgcagccaccagtgggagagacaagccagtcctaagagaaaaggtggtggcagccacaaattctaggtacactggctgctgcctatcctgtccctggatctgaggcctttcccttgccatagaaatggttgctggtagcagtagagagcactgtgcacctgggaatgaggaatcaggccccaagacagaagtacttggaggagccagctgcagtagtatccgcctgtagtcccagctactcaggaggctgagacaggaggattgcttaagcccaggagctcaagtcccacctgggcaacatagtaagatcttgtctcttaaaaaaaaaaaaaaaggtacttagaggtcgcacttaaagattatgcacatcagcagaggaaaggccagccaagcttggggcaagcttgatgcagtaggagagactccttatgaggcttagcccttgtcttactgccagcctttgccacaggcaggtgagaaaggcagggccactcctcagcaaagttggcctcttctacacttcctcaccagtgttgtttcttccttttttcccctcttccccttcccgtcttgtgttttttctgaaccccacatctgccatcatttctctcctctagagtccctggcttctggccactgcctcctccctcttctaagccttggcctgaatctggttgatcagaggcaagtgtggatcctttgggtggcagtcaggggagatctcagggcctctgttgggaggaatctctgtaattcctgcttgggctccaaatttctgaagagtaatatttttaaactatagcttacaaaatacattctctgaccacagtctcctccttgatatacaagggatggatgaagttcatgtattaggactggcactccttacggtgcttatagaactagtctcaccacttgactcattacgtcgtcattcttgttacatcactcatacttttagctgcaaccacactaattcacatttttatatactttcaattagctgtactaattggggcttgaaagtatataaaatcttcctgtcctgtgaattttaaaaagctatcccatatcgattgccaaagagcatctaccttacctcctaagaagaaaagccactttcttccaatccaagcccactgcagccttgtggattttccacacagcagcttttcactgtatgcctgtacttgggctgcactgagcttgtcttcaggaaaccagagcgttgctttatcatcgcacttttcatcttggtaatatcaaaacaactttttaaatgaactgattgatatatgttatttcttgcgaggttttcctctggcctttaactggcttctgaggctacagaactccaacccagagttcttcgggacctaaattttgcttaaggaaggcctttatcatgctgaaagcactcagacatgtctgtcctcacagcagaatgtagaagtcatatgaatgagggatcgtgcacggtagcgtcagcccgaattgacacgacaactctgaatgtgtggccctctatgaaagctggtgccagttttcatcactgttattaaatactagattgggaacctcattcagccgtattgcacagatgagcaattacagcagagaaaattcattagtgctcccactcatatccttatgtgtgagttggtgaaatttagcctgagcttgattcttaggtcttgagactcagtttccaacaccttcattattaatgttaagaatggccatataccacttcatttacgtaaaaggaataaaataagcaagttaagcttcagggtcctagaatttttctgatttctataatccttcagcagaatattaagaaataaagcatgatctgcaatggaaaggtttttttggcactaacttcatgcagaatttcacagacatctatgcattaatttaaattcttggtgcaaatgtgtgctttgtagttcaaccttattaaaaattcttcagccagttaggatttcaaaatacattagtgagagtaacagctagcagaataattacaatggctaaaacgtttttatagagaatcttgtttttcaaaaaagaataaaaagtttgaatagctattattaaagaaaagccatgtcttcaacatctgagtcaccaagaagtaacactttttaaacttgttagaaatccctggaggcatttcaaattcatcttctaacctacctaagcactttaaaatacagcctccttctgttcctctgttccccttcatgcctccttttgaattgatatctcagctgtcaatatttctttgacttcagcattgttattttatttctctatatcaatgtgtccttagttttcttagcctgttaatttaaaaatccagacttgggggtcattgtgttgctacccaagagaaaatgctacagttttatagattgcacatcattctttaaggcatacttttacctcaggaaacttactctagtatgttctcatatattgaattctcaactaagtaactatttctttatacctataaactagtacctaattcactgttagttaaatgagctatagataaggcagctaaatttctgaaagatagccagagtaagtaagcagccactgcaagctctgaatcagttttttaaaaaaaagaaaaaaaaaaaaaaggagctgtgccccattgaacaatgacaacatcacaaggggaagggagggattttgccaaaagttagaaaggtggagctgtaagccatgtgcttgttgcctttgacagtgacagtgcgcgtcttacaactaattccactaggcatgggaatgtcacctcctttgccactgtaccccatcaagcttactctgaatcaaaggttttgtaaaacttttgaaaatgaacttagctgcaaaatatagctaaccactttccattgcaagctttgcaaagtgaagagaggttcgtacttctcataattggtatttagcacaattgtaagatacagttttactgtttgtacatcgtttttttccattaaacttttctagagaagacaaaagcttacactggtgacatggataagtgagatggtgtctaacgagcagtgcaatattaggcggtgcaatagaggccctgttggcaagatgagttttgctggagagctggacagtgttggttagcttcctgcattgattgcccctgggcgttcttcccccttaactgtgaaagcagagtctataaatgaactctttgctcttacaaggtaatttacatattttctttctgttgaaataactgaaaatgttaaatctaccagtttatgtcttgtaaacagagtgtcatatgtatttaagttgtgtatttttataaagtaaagccaagtatcaaacaaaaaaa

SEQ ID NO: 369394 - DNA, 554 bp, Homo sapiens
caagcttatgcatgcggccgctgaatggaggccaacatgccgaagcggaaggagcccggcaggtctctccgcatcaaagtcatctccatgggcaacgccgaagtggggaaaagctgtattataaagcgatactgtgagaaaagattcgtgtctaaatacctggcaacaattggaattgactatggagtcacaaaggtacacgtcagagacagagaaatcaaagttaacatctttgatatggctggacatcccttcttctatgaggtaagaaagcctttttgacaaaacctatatccagtattgttggtggtttggggagagatccagaattatatgaaacaaccaatattgatatcatgtgtaaaattgcataattttagcttgatcgtggcttgccttcagagccttgagttaatagacaactgttgattttttaggttatcctgttaaatagtggtaggaaatttcattgccaatatttcaaacatttcaataagacattttgactttcagaggacttttgctttttacctcatactttagcctaaaatgtg

SEQ ID NO: 369395 - DNA, 259 bp, Homo sapiens
atctgtccttttatttgaaggttcgaaatgagttttacaaggacacacagggtgtgatactggtctatgatgttgggcagaaagactcctttgacgcccttgatgcgtggctggcagaaatgaagcaagagcttggacctcatggaaacatggaaaatattatatttgtagtttgtgccaacaaggtaacccctctggaaatggtgtgttcagatttctagggaaagagtggagctttgagtgttgggaaacaaaaaga

SEQ ID NO: 369396 - DNA, 441 bp, Homo sapiens
tgttttccattgtaagtccttctatgctaatacatttttagaatgacattactttgattctataaaaaaccctctaatgaccagtagaaacagatacaatagcaaacactaagaatacacaaaagaacacactttgccaggttaatgactgtgagatacattcttataacatcacaaaaactacgttttgtgtatctgtccttttatttgaaggttcgaaatgagttttacaaggacacacagggtgtgatactggtctatgatgttgggcagaaagactcctttgacgcccttgatgcgtggctggcagaaatgaagcaagagcttggacctcatggaaacatggaaaatattatatttgtagtttgtgccaacaaggtaacccctctggaaatggtgtgttcagatttctagggaaagagtggagctttgagtgttggg

SEQ ID NO: 369397 - DNA, 5139 bp, Homo sapiens
agcgggtctccctcccccggctccccacgctcccaaccgcccgcgcctgctgccaggcagcggcggggatggcgagcagcggaggcgaggcggtgacgagagcagcggctccgccattggacgaggaggcctgagggacgggccagcggtgcacaagaagagaccgaggcgggtggccccgagagagccagggccatggaggccaacatgccgaagcggaaggagcccggcaggtctctccgcatcaaagtcatctccatgggcaacgccgaagtggggaaaagctgtattataaagcgatactgtgagaaaagattcgtgtctaaatacctggcaacaattggaattgactatggagtcacaaaggtacacgtcagagacagagaaatcaaagttaacatctttgatatggctggacatcccttcttctatgagatgaggaaactgagacgcagagaggttaagtgacttgcccaagatcacaaaactagttcgaaatgagttttacaaggacacacagggtgtgatactggtctatgatgttgggcagaaagactcctttgacgcccttgatgcgtggctggcagaaatgaagcaagagcttggacctcatggaaacatggaaaatattatatttgtagtttgtgccaacaagattgattgtaccaaacatcgctgtgtagatgaaagtgaaggacgtctttgggctgaaagcaaagggttcctgtactttgaaacttcagcacaaactggagaaggcattaatgagatgttccagatacatcttggatagaactaatggataaattagtctgtttaaaaaaaaaaagctaacaagaagagaataattacagtattctataaaccttttatatatccatagttgatttatgtgaaaatggcgggaaacgccctaccaccaatagcagtgctagtttcaccaaagaacaagcagatgccattcgcagaattcgaaatagtaaagacagttgggacatgctgggagtcaaacctggggcctcaagggatgaagtcaataaagcgtatcggaaacttgctgtgcttcttcaccctgacaaatgtgtagcacctggcagtgaagatgccttcaaagcagttgtgaatgctcggacagccctcctgaaaaacatcaagtagaaagtacagaaaaaagccacatgtgggactcaaatgcaaacagactttccctagaggtgaaataaccaacgtggagttttccttcccagaatctcactgctcttttcattcatgtgttgtcatttgtatatcagtaattcaggtacccatttcatagacattttactgagaaatgacctgcatttgtatgaagtgaactgagcgtcacaccctgtacttcatttcatatttctagataattctgaatttttttctcattcgtcagctctgtaattatagtatcacttagacatttcacttggggaaatccacaaggttcctggaggagggaagagaggacaagaggaccctttcactttttcttttttacggaattcatcatcagagaagaaaataacaaaaatggaagcaaacaacatcagaacccctgtaagtttggtgtgaccttacagacaagttgctgcttttacaatgagttccttaggtggtattttaacccatcgatctataatgatgactcttggcagccctttgggagtttgtaaaatgaggtgatacagttctgaattgagcattcctttatgatattcactctgttcctcttctgcagccaccagtgggagagacaagccagtcctaagagaaaaggtggtggcagccacaaattctaggtacactggctgctgcctatcctgtccctggatctgaggcctttcccttgccatagaaatggttgctggtagcagtagagagcactgtgcacctgggaatgaggaatcaggccccaagacagaagtacttggaggagccagctgcagtagtatccgcctgtagtcccagctactcaggaggctgagacaggaggattgcttaagcccaggagctcaagtcccacctgggcaacatagtaagatcttgtctcttaaaaaaaaaaaaaaaggtacttagaggtcgcacttaaagattatgcacatcagcagaggaaaggccagccaagcttggggcaagcttgatgcagtaggagagactccttatgaggcttagcccttgtcttactgccagcctttgccacaggcaggtgagaaaggcagggccactcctcagcaaagttggcctcttctacacttcctcaccagtgttgtttcttccttttttcccctcttccccttcccgtcttgtgttttttctgaaccccacatctgccatcatttctctcctctagagtccctggcttctggccactgcctcctccctcttctaagccttggcctgaatctggttgatcagaggcaagtgtggatcctttgggtggcagtcaggggagatctcagggcctctgttgggaggaatctctgtaattcctgcttgggctccaaatttctgaagagtaatatttttaaactatagcttacaaaatacattctctgaccacagtctcctccttgatatacaagggatggatgaagttcatgtattaggactggcactccttacggtgcttatagaactagtctcaccacttgactcattacgtcgtcattcttgttacatcactcatacttttagctgcaaccacactaattcacatttttatatactttcaattagctgtactaattggggcttgaaagtatataaaatcttcctgtcctgtgaattttaaaaagctatcccatatcgattgccaaagagcatctaccttacctcctaagaagaaaagccactttcttccaatccaagcccactgcagccttgtggattttccacacagcagcttttcactgtatgcctgtacttgggctgcactgagcttgtcttcaggaaaccagagcgttgctttatcatcgcacttttcatcttggtaatatcaaaacaactttttaaatgaactgattgatatatgttatttcttgcgaggttttcctctggcctttaactggcttctgaggctacagaactccaacccagagttcttcgggacctaaattttgcttaaggaaggcctttatcatgctgaaagcactcagacatgtctgtcctcacagcagaatgtagaagtcatatgaatgagggatcgtgcacggtagcgtcagcccgaattgacacgacaactctgaatgtgtggccctctatgaaagctggtgccagttttcatcactgttattaaatactagattgggaacctcattcagccgtattgcacagatgagcaattacagcagagaaaattcattagtgctcccactcatatccttatgtgtgagttggtgaaatttagcctgagcttgattcttaggtcttgagactcagtttccaacaccttcattattaatgttaagaatggccatataccacttcatttacgtaaaaggaataaaataagcaagttaagcttcagggtcctagaatttttctgatttctataatccttcagcagaatattaagaaataaagcatgatctgcaatggaaaggtttttttggcactaacttcatgcagaatttcacagacatctatgcattaatttaaattcttggtgcaaatgtgtgctttgtagttcaaccttattaaaaattcttcagccagttaggatttcaaaatacattagtgagagtaacagctagcagaataattacaatggctaaaacgtttttatagagaatcttgtttttcaaaaaagaataaaaagtttgaatagctattattaaagaaaagccatgtcttcaacatctgagtcaccaagaagtaacactttttaaacttgttagaaatccctggaggcatttcaaattcatcttctaacctacctaagcactttaaaatacagcctccttctgttcctctgttccccttcatgcctccttttgaattgatatctcagctgtcaatatttctttgacttcagcattgttattttatttctctatatcaatgtgtccttagttttcttagcctgttaatttaaaaatccagacttgggggtcattgtgttgctacccaagagaaaatgctacagttttatagattgcacatcattctttaaggcatacttttacctcaggaaacttactctagtatgttctcatatattgaattctcaactaagtaactatttctttatacctataaactagtacctaattcactgttagttaaatgagctatagataaggcagctaaatttctgaaagatagccagagtaagtaagcagccactgcaagctctgaatcagttttttaaaaaaaagaaaaaaaaaaaaaaggagctgtgccccattgaacaatgacaacatcacaaggggaagggagggattttgccaaaagttagaaaggtggagctgtaagccatgtgcttgttgcctttgacagtgacagtgcgcgtcttacaactaattccactaggcatgggaatgtcacctcctttgccactgtaccccatcaagcttactctgaatcaaaggttttgtaaaacttttgaaaatgaacttagctgcaaaatatagctaaccactttccattgcaagctttgcaaagtgaagagaggttcgtacttctcataattggtatttagcacaattgtaagatacagttttactgtttgtacatcgtttttttccattaaacttttctagagaagacaaaagcttacactggtgacatggataagtgagatggtgtctaacgagcagtgcaatattaggcggtgcaatagaggccctgttggcaagatgagttttgctggagagctggacagtgttggttagcttcctgcattgattgcccctgggcgttcttcccccttaactgtgaaagcagagtctataaatgaactctttgctcttacaaggtaatttacatattttctttctgttgaaataactgaaaatgttaaatctaccagtttatgtcttgtaaacagagtgtcatatgtatttaagttgtgtatttttataaagtaaagccaagtatcaaacaaaaaaa

SEQ ID NO: 369398 - DNA, 888 bp, Homo sapiens
ataactcactgtctaacaaagttttgaaaatttgtctgatatgtaattaggtactttagggttattaggttttcataaaaattctggttagggctcttgccctgctcccaatgaaagcctttccacagggcaaatataaaagagagagtagagggaatccccctgaggtttaaataagtcaaaccagtaagtaatagtgctaagtttgtcagtgcctctctttcttactgtacttaacatctaaagggcacctcatttattttcagctaattatgttctttatgagtgactgtcaaatcagggaagggtgtgacgatcatgtggagataccttttctaattaatagctgccttgctcctcaagattctgatgaatgttgggaaaggaaaaaagttgaggtgcaaacaatgtgagaaatttaataattgagagatacttaaattttttatctattgctgtataacaaactacccctaaacttagcagcttaaaacaatgaacatttatctattatctcacatagttttgtgcatcagaaatttaggagccacttagcagagttgttctggctcagggattctcataacattgtaggcaagatgttggcaaggctgaagtcatctgaaggcctctttggggtgggaggatggctattgtcaggagactttacttcctctctggcttttggcaggaagccttagttgttaatcatgtggacctctctgtagagctgtttgggtaatctcaggacatggcctagagtgagtagtcccagctacttgggaagctgaggtgggaggattgcttgagcctggaaggttgaggctgtagtgagccgtgatcgtggcatggcaccccagcctaggtggcaaagtgagaccctatctc

SEQ ID NO: 369399 - DNA, 668 bp, Homo sapiens
acgggcacacggacaccccaaagtaatgccagctgggaagcacctgggaaggacccagcacaaatgggaagacggaccagggatggtccacagaccaacgtcaccccgaccacacagggcaccctgagaacacaaccacccgcttcaggtctgtctgaagagcctccaatcacctagacttccctaattcactggaacaggaaaggtgttgccacaggcatacaaagcacttggtggtgagagtgagaacacttttggctccccctaatccaagccaggggaactcgcggggctcaggcgcagccctcgctgggtaatggaaggccctctcgcccaccttgccctttctgcggggctggcaaacactgacatctgaggaccgtggggtgccaggccttcccattatcctctttcacaatcttccgaatcaaggtccactaacacctcatttatccaaaaatcagtcaatgaatgatcccagctgctcaagaaagccactccccacccctgcccaggagcccagaaggtgccactaatgccacacctcacccagggccagtattctcttcctttatacccagctgtagctggctttccgggtaggcatgggtgagcagaaagagggtgaagagcacctggctgggcacggtgaccatggccggcagggc

SEQ ID NO: 369400 - DNA, 560 bp, Homo sapiens
  misc_feature (535)..(535): n is a, c, g, or t
acgggcacacggacaccccaaagtaatgccagctgggaagcacctgggaaggacccagcacaaatgggaagacggaccagggatggtccacagaccaacgtcaccccgaccacacagggcaccctgagaacacaaccacccgcttcaggtctgtctgaagagcctccaatcacctagacttccctaattcactggaacaggaaaggtgttgccacaggcatacaaagcacttggtggtgagagtgagaacacttttggctccccctaatccaagccaggggaactcgcggggctcaggcgcagccctcgctgggtaatggaaggccctctcgcccaccttgccctttctgcggggctggcaaacactgacatctgaggaccgtggggtgccaggccttcccattatcctctttcacaatcttccgaatcaaggtccactaacacctcatttatccaaaaatcagtcaatgaatgatcccagctgctcaagaaagccactccccacccctgcccaggagcccagaaggtgggaggnggcatcgataaacaccgggtaccga

SEQ ID NO: 369401 - DNA, 1219 bp, Homo sapiens
gcacgaggcggcacgaggcggcacgaggctgatgtggaaaaaagaaatgcaagggaaaacataaaacagatagtaaaactccttgcaagtgttcgagctttggatcatgctatgtctgttgcaagtgaccacaatgtgaaagaatttaagtctttgatcgaaggaaaatagatctatgagactgaaaaacctatttgcttgattaccattcccaatgtgtaaattttgtatatatgtaaagtttcttaaactgtaaaatagcaattcttgttttaatacaaaaaacattatattcaatactgtgtccttaaatgatatttcttcagaatgaaaggaattcagattatttctaggagtctatgaatgttttctttactgcctgtcatactttgtttactgaagtattttgtatggtcatttaaattaaccctctcagttaattgtcccctgtaaacgatgtgtgcagtgtaaattgtgtaattatgcatatatatatttataccaccatggacttactttcacactgggaaatttgtggtgtttttccacagaggaagccttttaacagcagaaaattatccggtagcaaattgtcttagggaaattactacactgttgtaacaaaagggctggcaagtgactaaatgttcattaccttttggttagcgttgctatcactgtagctgtgctgccttaacattgagagttgagttgtggacttagtcattgagtgaatgttgaactttcttccttgaatcagcgttagagtcaaatgtgggtttaatgtgaatgctaaatgaatatgcaacatagtttcaaatggaacatagaaatttcacttttgaaaataataaacccacaacctaattgcatggttttgggctgaccgtcctgtctcattcatgattttactccctgcccagcttgcagatacatgcatttgaattttagtagtctgtcatatttaaaatcccacatatgtgagttaaatatgcaataaagaatacgccttgctgattagccacacccaggcaatttaatatccatggtcttctataatgtttataccacattgtaaatattcagagaacttgttttaaagtttatgctttctgattctgtgattttcaaaagaggaatttttttggaaattaaggactatcgtttgataattatatatgtaattaagatttagccaagcattaaattaatttttaaa

SEQ ID NO: 369402 - DNA, 1024 bp, Homo sapiens
gagtgtaattttgaatggaggacacttacctaagactcagcactccctgatagtactgtctgcaatgatggaaaatgttctgtatctgtgctgaccagtgctgtagccactagctacatgtggctgtttcgattttgactaattaaaattgaatattcaaatgtaaccattctaggaaatatctgtacctttgaaagtattaatatttcttagtactttggcaagacatggtctgctgtatttcatatggtgttttactatgtaacttatttactttgtacctaatctaattgtttcacattacctattttttttcttctttccagctgttaggcaattttcttcagtggtatggcattttctcaaataaaactctgcaagagttatcaatagatggtttattaaatcgatatattctcatggcttttcagaattcagaatatggagatgacagcatcaaaaaagcccaaaatgtgagttaaatgcatagtacagtttttaaagcatataatttaaaatgaattaagtttttgtttgtttgaagagggatttgagaattttatgaaacccctttgattactggacttgcatgtaaggttgacagtttgcctacccaggtagttccaaccccctacagcattttttacataaaaatgcatactgttatatatatatatatccatctatatccatatttttatagatattagtgaaagttttgatatttttataggtataaataaaagttttgatttcagaataataaccttattatcttaacctcagtctgggccaactcgacttcccttagcagcatgcatggatgtctattcgtggaattattgcaggggatgggggtgctgtaatttcatttttataccactcatttttacatcaaaagctgctggaaaaggaaattcagtatatttaggccatcctagaagactggaaaatgaagcagttggttgtcagttttatgttactaatttactcaaatattggacagattatcttttgctttgag

SEQ ID NO: 369403 - DNA, 423 bp, Homo sapiens
tggataaatgtaaacttttttttttttaacatgctgtagcttgcatatctgtttcctttctttgaaaatgtgtgcttggaaaaattgattgcagaagctctaaaatagccatgaaatcagtagcaaattttctcttagatatactaattaatgagatgctgctatatttttttcttttagggaaaacataaaacagatagtaaaactccttgcaagtgttcgagctttggatcatgctatgtctgttgcaagtgaccacaatgtgaaagaatttaagtctttgatcgaaggaaaatagatctatgagactgaaaaacctatttgcttgattaccattcccaatgtgtaaattttgtatatatgtaaagtttcttaaactgtaaaatagcaattcttgttttaatacaaaaaacattatattca

SEQ ID NO: 369404 - DNA, 480 bp, Homo sapiens
tttgcttttaatactttaatttattctgtcttaactattttattttacgtctttcttctccacaggtaatcaattgtttccccaaacaatggttcatgaatagttccgcatgggtgggaaggcctcaggaaacttacaatcttgacgaaaggcacgtcttcacagggtggctggggctgtctctctcctgatggaaagtcacatcagccttgtgttaatttcttgtagctggtgttacaaattaccatgaactgggtggtttaaaacaacaaaaatgtattttcttgcagttctggaggccagaaccaacagggccatgctccttccaaaggctctaggctcaaatccttccttgcctcttccaacttctgatggctgctgacatagcttggctatggccacatcgctccaatctctgctgctgtcttcacatcacttttttttctctctctctctctcctgtgtgcgtgtttaattttc

SEQ ID NO: 369405 - DNA, 4107 bp, Homo sapiens
agtattgagagcgcgtgggagcataggcgcatgcgcgctcgtggggtgcgcggtagcaacagaggactcgacccggctggagctccggagagcgcgcgtgcgccgtcacgagctcggcgctgccggggccgcggtgtggaagcgagtattcgaccgccgtgcgggccgcggggatgttccgaaaggcccggcgggtgaacgtgcgcaagcggaacgactccgaagaggaagagcgggaacgcgatgaggagcaggagccgccgccgttgttgccgccgccgggcacgggcgaagaggcgggccccggtggcggcgacagggcccctggcggggagtcgctgctgggcccggggccgtcgccgccttccgcgctgaccccgggcctcggggctgaggccgggggcggcttccccggcggcgcggagcccggcaacgggctgaagccgcgcaagaggcctcgcgagaacaaagaggtgccccgggccagcctgctcagcttccaggacgaggaggaagaaaatgaagaagttttcaaagtgaagaaatcaagttatagcaaaaagatagtaaaattgctcaagaaggaatataaagaagatcttgaaaaatcgaagattaagacagaactcaactcatcagctgaaagtgaacaacctttggacaaaacaggacatgttaaggatacaaatcaagaagatggagttatcatcagtgaacatggtgaagatgaaatggatatggaaagtgaaaaagaggaagaaaagccaaagactggtggagctttttcaaatgctttatcttcattgaatgttcttcgtccaggagaaattccagatgcagcttttatacatgctgcaaggaaaaagcgccaaatggcccgagaattgggagatttcactcctcatgataatgagcctggtaaaggccgccttgttagagaagatgagaatgatgccagtgatgatgaagatgacgatgagaaacgccggatagttttttctgtgaaagaaaagtcacaaagacaaaaaattgctgaggaaataggaattgaggggagtgatgatgatgctttagtaactggagaacaggatgaagagctcagccgatgggaacaggagcagataaggaaaggaattaatatccctcaggttcaagccagtcaacccgcagaagtgaatatgtactaccagaacacttaccagacaatgccttacggctcatcctatggcattccttatagttatacggcctatggatcatcagatgccaaatctcaaaaaacagataatacagtccctttcaaaactcccagtaatgagatgactcccgttactattgatttggtaaagaaacagcttaaagacaggttggactccatgaaagaattgcacaaaacaaatcgacagcagcatgagaaacatctgcaaagccgagtggactctaccagggctattgaaagattagaagggtcttctgggggtattggtgaacggtataaatttttgcaagaaatgcgagggtatgtccaagacttgcttgagtgtttcagtgaaaaggtgccactgattaatgaacttgaatcagcaatacatcagctgtacaaacagcgagcttcccgccttgtccaaagacgacaagatgatattaaagatgaatcttcggagttttcaagccattcaaacaaagctctgatggcaccaaatcttgactcctttggacgcgatcgggcactgtatcaagagcatgcaaaacgtcgcattgcagagcgggaggccaggaggactcgtcgtagacaagccagagaacaaaccggtaagatggcagatcaccttgaaggcctttccagtgatgatgaagaaacttctacagatattactaatttcaatctggaaaaagatcgaatttcaaaagaatccggcaaagtttttgaagatgtccttgaaagtttctattcaattgactgtattaaatcacagtttgaagcatggcgttcaaaatactacacatcctacaaagatgcttacattggcctttgtttgccaaaattattcaaccccctcatacgacttcagctcctcacttggactcctcttgaggcaaaatgtcgtgactttgagaatatgctgtggtttgaatctttgctgttttatggttgtgaagaacgagagcaagaaaaagatgatgtagatgttgccctactacctaccattgtggaaaaggtgattcttcctaaactaacagtgatagctgaaaatatgtgggaccctttttctacaacacagacttcaagaatggtgggaattacactaaaattaatcaatggatatccttcagtagtgaatgcagaaaataaaaatacacaggtatacctaaaggcacttttattgagaatgagaagaactttagatgatgatgtatttatgcccttatatcccaaaaatgtcttagaaaataaaaattctgggccttacttgttttttcaacgacagttttggtcttcagttaagctgttaggcaattttcttcagtggtatggcattttctcaaataaaactctgcaagagttatcaatagatggtttattaaatcgatatattctcatggcttttcagaattcagaatatggagatgacagcatcaaaaaagcccaaaatgtaatcaattgtttccccaaacaatggttcatgaatctgaaaggagaaaggactatttctcagttagaaaacttttgccgataccttgtacacttagcggatacaatttatagaaatagtatcgggtgttctgatgtggaaaaaagaaatgcaagggaaaacataaaacagatagtaaaactccttgcaagtgttcgagctttggatcatgctatgtctgttgcaagtgaccacaatgtgaaagaatttaagtctttgatcgaaggaaaatagatctatgagactgaaaaacctatttgcttgattaccattcccaatgtgtaaattttgtatatatgtaaagtttcttaaactgtaaaatagcaattcttgttttaatacaaaaaacattatattcaatactgtgtccttaaatgatatttcttcagaatgaaaggaattcagattatttctaggagtctatgaatgttttctttactgcctgtcatactttgtttactgaagtattttgtatggtcatttaaattaaccctctcagttaattgtcccctgtaaacgatgtgtgcagtgtaaattgtgtaattatgcatatatatatttataccaccatggacttactttcacactgggaaatttgtggtgtttttccacagaggaagccttttaacagcagaaaattatccggtagcaaattgtcttagggaaattactacactgttgtaacaaaagggctggcaagtgactaaatgttcattaccttttggttagcgttgctatcactgtagctgtgctgccttaacattgagagttgagttgtggacttagtcattgagtgaatgttgaactttcttccttgaatcagcgttagagtcaaatgtgggtttaatgtgaatgctaaatgaatatgcaacatagtttcaaatggaacatagaaatttcacttttgaaaataataaacccacaacctaattgcatggttttgggctgaccgtcctgtctcattcatgattttactccctgcccagcttgcagatacatgcatttgaattttagtagtctgtcatatttaaaatcccacatatgtgagttaaatatgcaataaagaatacgccttgctgattagccacacccaggcaatttaatatccatggtcttctataatgtttataccacattgtaaatattcagagaacttgttttaaagtttatgctttctgattctgtgattttcaaaagaggaatttttttggaaattaaggactatcgtttgataattatatatgtaattaagatttagccaagcattaaattaatttttaaaaacacaacacaaaaaaataaaaaaaaaaattttggtggggcgcttgtgggcctggaagaaagtttttaaaaaccctttggttgtgggggggggggcccaaggtgggtttggtggacctgggccaataggggt

SEQ ID NO: 369406 - DNA, 2628 bp, Homo sapiens
gggtgtcatggccggctcctaccctgaaggtgcacctgcagtcctcgccgataagaggcagcagttcggaagccggttcctgagagatccggcgcgcgtcttccaccacaatgcctgggacaatgtggagtggtcggaagagcaagccgcggcggcggagagaaaagtccaggagaacagtatccagcgggtgtgccaggagaaacaaggtgccactgattaatgaacttgaatcagcaatacatcagctgtacaaacagcgagcttcccgccttgtccaaagacgacaagatgatattaaagatgaatcttcggagttttcaagccattcaaacaaagctctgatggcaccaaatcttgactcctttggacgcgatcgggcactgtatcaagagcatgcaaaacgtcgcattgcagagcgggaggccaggaggactcgtcgtagacaagccagagaacaaaccggtaagatggcagatcaccttgaaggcctttccagtgatgatgaagaaacttctacagatattactaatttcaatctggaaaaagatcgaatttcaaaagaatccggcaaagtttttgaagatgtccttgaaagtttctattcaattgactgtattaaatcacagtttgaagcatggcgttcaaaatactacacatcctacaaagatgcttacattggcctttgtttgccaaaattattcaaccccctcatacgacttcagctcctcacttggactcctcttgaggcaaaatgtcgtgactttgagaatatgctgtggtttgaatctttgctgttttatggttgtgaagaacgagagcaagaaaaagatgatgtagatgttgccctactacctaccattgtggaaaaggtgattcttcctaaactaacagtgatagctgaaaatatgtgggaccctttttctacaacacagacttcaagaatggtgggaattacactaaaattaatcaatggatatccttcagtagtgaatgcagaaaataaaaatacacaggtatacctaaaggcacttttattgagaatgagaagaactttagatgatgatgtatttatgcccttatatcccaaaaatgtcttagaaaataaaaattctgggccttacttgttttttcaacgacagttttggtcttcagttaagctgttaggcaattttcttcagtggtatggcattttctcaaataaaactctgcaagagttatcaatagatggtttattaaatcgatatattctcatggcttttcagaattcagaatatggagatgacagcatcaaaaaagcccaaaatgtaatcaattgtttccccaaacaatggttcatgaatctgaaaggagaaaggactatttctcagttagaaaacttttgccgataccttgtacacttagcggatacaatttatagaaatagtatcgggtgttctgatgtggaaaaaagaaatgcaagggaaaacataaaacagatagtaaaactccttgcaagtgttcgagctttggatcatgctatgtctgttgcaagtgaccacaatgtgaaagaatttaagtctttgatcgaaggaaaatagatctatgagactgaaaaacctatttgcttgattaccattcccaatgtgtaaattttgtatatatgtaaagtttcttaaactgtaaaatagcaattcttgttttaatacaaaaaacattatattcaatactgtgtccttaaatgatatttcttcagaatgaaaggaattcagattatttctaggagtctatgaatgttttctttactgcctgtcatactttgtttactgaagtattttgtatggtcatttaaattaaccctctcagttaattgtcccctgtaaacgatgtgtgcagtgtaaattgtgtaattatgcatatatatatttataccaccatggacttactttcacactgggaaatttgtggtgtttttccacagaggaagccttttaacagcagaaaattatccggtagcaaattgtcttagggaaattactacactgttgtaacaaaagggctggcaagtgactaaatgttcattaccttttggttagcgttgctatcactgtagctgtgctgccttaacattgagagttgagttgtggacttagtcattgagtgaatgttgaactttcttccttgaatcagcgttagagtcaaatgtgggtttaatgtgaatgctaaatgaatatgcaacatagtttcaaatggaacatagaaatttcacttttgaaaataataaacccacaacctaattgcatggttttgggctgaccgtcctgtctcattcatgattttactccctgcccagcttgcagatacatgcatttgaattttagtagtctgtcatatttaaaatcccacatatgtgagttaaatatgcaataaagaatacgccttgctgattagccacacccaggcaatttaatatccatggtcttctataatgtttataccacattgtaaatattcagagaacttgttttaaagtttatgctttctgattctgtgattttcaaaagaggaatttttttggaaattaaggactatcgtttgataattatatatgtaattaagatttagccaagcattaaattaatttttaaa

SEQ ID NO: 369407 - DNA, 2411 bp, Homo sapiens
cagaatcttgccgttgagattagcaagcagtctgtcgtaatggcttattctgtgcaaactctttcctcaagattgttgaaagatggcttttaattttaactgttgttgttttgcagacaaagctctgatggcaccaaatcttgactcctttggacgcgatcgggcactgtatcaagagcatgcaaaacgtcgcattgcagagcgggaggccaggaggactcgtcgtagacaagccagagaacaaaccggtaagatggcagatcaccttgaaggcctttccagtgatgatgaagaaacttctacagatattactaatttcaatctggaaaaagatcgaatttcaaaagaatccggcaaagtttttgaagatgtccttgaaagtttctattcaattgactgtattaaatcacagtttgaagcatggcgttcaaaatactacacatcctacaaagatgcttacattggcctttgtttgccaaaattattcaaccccctcatacgacttcagctcctcacttggactcctcttgaggcaaaatgtcgtgactttgagaatatgctgtggtttgaatctttgctgttttatggttgtgaagaacgagagcaagaaaaagatgatgtagatgttgccctactacctaccattgtggaaaaggtgattcttcctaaactaacagtgatagctgaaaatatgtgggaccctttttctacaacacagacttcaagaatggtgggaattacactaaaattaatcaatggatatccttcagtagtgaatgcagaaaataaaaatacacaggtatacctaaaggcacttttattgagaatgagaagaactttagatgatgatgtatttatgcccttatatcccaaaaatgtcttagaaaataaaaattctgggccttacttgttttttcaacgacagttttggtcttcagttaagctgttaggcaattttcttcagtggtatggcattttctcaaataaaactctgcaagagttatcaatagatggtttattaaatcgatatattctcatggcttttcagaattcagaatatggagatgacagcatcaaaaaagcccaaaatgtaatcaattgtttccccaaacaatggttcatgaatctgaaaggagaaaggactatttctcagttagaaaacttttgccgataccttgtacacttagcggatacaatttatagaaatagtatcgggtgttctgatgtggaaaaaagaaatgcaagggaaaacataaaacagatagtaaaactccttgcaagtgttcgagctttggatcatgctatgtctgttgcaagtgaccacaatgtgaaagaatttaagtctttgatcgaaggaaaatagatctatgagactgaaaaacctatttgcttgattaccattcccaatgtgtaaattttgtatatatgtaaagtttcttaaactgtaaaatagcaattcttgttttaatacaaaaaacattatattcaatactgtgtccttaaatgatatttcttcagaatgaaaggaattcagattatttctaggagtctatgaatgttttctttactgcctgtcatactttgtttactgaagtattttgtatggtcatttaaattaaccctctcagttaattgtcccctgtaaacgatgtgtgcagtgtaaattgtgtaattatgcatatatatatttataccaccatggacttactttcacactgggaaatttgtggtgtttttccacagaggaagccttttaacagcagaaaattatccggtagcaaattgtcttagggaaattactacactgttgtaacaaaagggctggcaagtgactaaatgttcattaccttttggttagcgttgctatcactgtagctgtgctgccttaacattgagagttgagttgtggacttagtcattgagtgaatgttgaactttcttccttgaatcagcgttagagtcaaatgtgggtttaatgtgaatgctaaatgaatatgcaacatagtttcaaatggaacatagaaatttcacttttgaaaataataaacccacaacctaattgcatggttttgggctgaccgtcctgtctcattcatgattttactccctgcccagcttgcagatacatgcatttgaattttagtagtctgtcatatttaaaatcccacatatgtgagttaaatatgcaataaagaatacgccttgctgattagccacacccaggcaatttaatatccatggtcttctataatgtttataccacattgtaaatattcagagaacttgttttaaagtttatgctttctgattctgtgattttcaaaagaggaatttttttggaaattaaggactatcgtttgataattatatatgtaattaagatttagccaagcattaaattaatttttaaa

SEQ ID NO: 369408 - DNA, 1346 bp, Homo sapiens
tggataaatgtaaacttttttttttttaacatgctgtagcttgcatatctgtttcctttctttgaaaatgtgtgcttggaaaaattgattgcagaagctctaaaatagccatgaaatcagtagcaaattttctcttagatatactaattaatgagatgctgctatatttttttcttttagggaaaacataaaacagatagtaaaactccttgcaagtgttcgagctttggatcatgctatgtctgttgcaagtgaccacaatgtgaaagaatttaagtctttgatcgaaggaaaatagatctatgagactgaaaaacctatttgcttgattaccattcccaatgtgtaaattttgtatatatgtaaagtttcttaaactgtaaaatagcaattcttgttttaatacaaaaaacattatattcaatactgtgtccttaaatgatatttcttcagaatgaaaggaattcagattatttctaggagtctatgaatgttttctttactgcctgtcatactttgtttactgaagtattttgtatggtcatttaaattaaccctctcagttaattgtcccctgtaaacgatgtgtgcagtgtaaattgtgtaattatgcatatatatatttataccaccatggacttactttcacactgggaaatttgtggtgtttttccacagaggaagccttttaacagcagaaaattatccggtagcaaattgtcttagggaaattactacactgttgtaacaaaagggctggcaagtgactaaatgttcattaccttttggttagcgttgctatcactgtagctgtgctgccttaacattgagagttgagttgtggacttagtcattgagtgaatgttgaactttcttccttgaatcagcgttagagtcaaatgtgggtttaatgtgaatgctaaatgaatatgcaacatagtttcaaatggaacatagaaatttcacttttgaaaataataaacccacaacctaattgcatggttttgggctgaccgtcctgtctcattcatgattttactccctgcccagcttgcagatacatgcatttgaattttagtagtctgtcatatttaaaatcccacatatgtgagttaaatatgcaataaagaatacgccttgctgattagccacacccaggcaatttaatatccatggtcttctataatgtttataccacattgtaaatattcagagaacttgttttaaagtttatgctttctgattctgtgattttcaaaagaggaatttttttggaaattaaggactatcgtttgataattatatatgtaattaagatttagccaagcattaaattaatttttaaa

SEQ ID NO: 369409 - DNA, 2791 bp, Homo sapiens
agtattgagagcgcgtgggagcataggcgcatgcgcgctcgtggggtgcgcggtagcaacagaggactcgacccggctggagctccggagagcgcgcgtgcgccgtcacgagctcggcgctgccggggccgcggtgtggaagcgagtattcgaccgccgtgcgggccgcggggatgttccgaaaggcccggcgggtgaacgtgcgcaagcggaacgactccgaagaggaagagcgggaacgcgatgaggagcaggagccgccgccgttgttgccgccgccgggcacgggcgaagaggcgggccccggtggcggcgacagggcccctggcggggagtcgctgctgggcccggggccgtcgccgccttccgcgctgaccccgggcctcggggctgaggccgggggcggcttccccggcggcgcggagcccggcaacgggctgaagccgcgcaagaggcctcgcgagaacaaagaggtgccccgggccagcctgctcagcttccaggacgaggaggaagaaaatgaagaagttttcaaagtgaagaaatcaagttatagcaaaaagatagtaaaattgctcaagaaggaatataaagaagatcttgaaaaatcgaagattaagacagaactcaactcatcagctgaaagtgaacaacctttggacaaaacaggacatgttaaggatacaaatcaagaagatggagttatcatcagtgaacatggtgaagatgaaatggatatggaaagtgaaaaagaggaagaaaagccaaagactggtggagctttttcaaatgctttatcttcattgaatgttcttcgtccaggagaaattccagatgcagcttttatacatgctgcaaggaaaaagcgccaaatggcccgagaattgggagatttcactcctcatgataatgagcctggtaaaggccgccttgttagagaagatgagaatgatgccagtgatgatgaagatgacgatgagaaacgccggatagttttttctgtgaaagaaaagtcacaaagacaaaaaattgctgaggaaataggaattgaggggagtgatgatgatgctttagtaactggagaacaggatgaagagctcagccgatgggaacaggagcagataaggaaaggaattaatatccctcaggttcaagccagtcaacccgcagaagtgaatatgtactaccagaacacttaccagacaatgccttacggctcatcctatggcattccttatagttatacggcctatggatcatcagatgccaaatctcaaaaaacagataatacagtccctttcaaaactcccagtaatgagatgactcccgttactattgatttggtaaagaaacagcttaaagacaggttggactccatgaaagaattgcacaaaacaaatcgacagcagcatgagaaacatctgcaaagccgagtggactctaccagggctattgaaagattagaagggtcttctgggggtattggtgaacggtataaatttttgcaagaaatgcgagggtatgtccaagacttgcttgagtgtttcagtgaaaaggtgccactgattaatgaacttgaatcagcaatacatcagctgtacaaacagcgagcttcccgccttgtccaaagacgacaagatgatattaaagatgaatcttcggagttttcaagccattcaaacaaagctctgatggcaccaaatcttgactcctttggacgcgatcgggcactgtatcaagagcatgcaaaacgtcgcattgcagagcgggaggccaggaggactcgtcgtagacaagccagagaacaaaccggtaagatggcagatcaccttgaaggcctttccagtgatgatgaagaaacttctacagatattactaatttcaatctggaaaaagatcgaatttcaaaagaatccggcaaagtttttgaagatgtccttgaaagtttctattcaattgactgtattaaatcacagtttgaagcatggcgttcaaaatactacacatcctacaaagatgcttacattggcctttgtttgccaaaattattcaaccccctcatacgacttcagctcctcacttggactcctcttgaggcaaaatgtcgtgactttgagaatatgctgtggtttgaatctttgctgttttatggttgtgaagaacgagagcaagaaaaagatgatgtagatgttgccctactacctaccattgtggaaaaggtgattcttcctaaactaacagtgatagctgaaaatatgtgggaccctttttctacaacacagacttcaagaatggtgggaattacactaaaattaatcaatggatatccttcagtagtgaatgcagaaaataaaaatacacaggtatacctaaaggcacttttattgagaatgagaagaactttagatgatgatgtatttatgcccttatatcccaaaaatgtcttagaaaataaaaattctgggccttacttgttttttcaacgacagttttggtcttcagttaaggtcataaaacccccattccagagagggtcctgccccatacccagaaggaaagaatgctgctcagagaggccaagaagaatctggacggacaggccttgtgttgtcttctcttgagcagtagatcatacctttttgtccagtcatgtttctgcatgcctgtacatatttcgttaaacctaaacatagtagacaatttctcctccatctttgggtcttcattctgaaggctgtcatgttacataaaactgtgatcaaataaatttatatgccttttctcctgttaa

SEQ ID NO: 369410 - DNA, 1056 bp, Homo sapiens
ttttttttttccattttacaaagtattttattccaaaagttcattcaagtttgatattttcacaggagaaagtgatttctgagttccaaagtaaggtccatcgtactcaacgaaatgcctgactaagccacaattaattttttcagcaagtagactacagtagtcctccctgtatccatggggtatatgttctaagatgcccagtggctacctgaaaccacagatagtaccgaaccctatatatactgttttttcctctacatacatacctatgataaagtttaacttataaattaggcacagtaagagattaacaataactaataatagaacagttattaataatatactgtggtaaaggttatatgaatgtagtttctctctcaaaatatgttattgtactgtgccacagctgactgaaaccacagataaggagtactgctgtagcagatactcttctgaggttcggggatatagcactgagtaagctagaagtggaatctttgtggagttcacagtccagcacagttgacaacaaataggtaatctcaggtgtgatgagttatgaaaggggacattcaaggtaatgtggaacatatgacaaggggcacagagaccttgactagctagtcccagaagatttccttccaccctgaggaagtgatatttagatcattcgacctggagaaaaaatagaagttagccctgaggtgaaagagagcaggctacactggaggcgctgaagaaagcataggacagctggagtgagcaagtcataaaacccccattccagagagggtcctgccccatacccagaaggaaagaatgctgctcagagaggccaagaagaatctggacggacaggccttgtgttgtcttctcttgagcagtagatcatacctttttgtccagtcatgtttctgcatgcctgtacatatttcgttaaacctaaacatagtagacaatttctcctccatctttgggtcttcattctgaaggctgtcatgttacataaaactgtgatcaaataaatttatatgccttttctcctgttaa

SEQ ID NO: 369411 - DNA, 597 bp, Homo sapiens
ttttttttttccattttacaaagtattttattccaaaagttcattcaagtttgatattttcacaggagaaagtgatttctgagttccaaagtaaggtccatcgtactcaacgaaatgcctgactaagccacaattaattttttcagcaagtagactacagtagtcctcccttcccagaagatttccttccaccctgaggaagtgatatttagatcattcgacctggagaaaaaatagaagttagccctgaggtgaaagagagcaggctacactggaggcgctgaagaaagcataggacagctggagtgagcaagtcataaaacccccattccagagagggtcctgccccatacccagaaggaaagaatgctgctcagagaggccaagaagaatctggacggacaggccttgtgttgtcttctcttgagcagtagatcatacctttttgtccagtcatgtttctgcatgcctgtacatatttcgttaaacctaaacatagtagacaatttctcctccatctttgggtcttcattctgaaggctgtcatgttacataaaactgtgatcaaataaatttatatgccttttctcctgttaa

SEQ ID NO: 369412 - DNA, 338 bp, Homo sapiens
agggctattgaaagattagaagggtcttctgggggtattggtgaacggtataaatttttgcaagaaatgcgagggtatgtccaagacttgcttgagtgtttcagtgaaaaggtaagaatgcaaaaatactaatctctttgaataaggcaaaattagggaggtctagatggccttgtgtagaacattctataattctcagaaagtacccactgaactcaacattagaagtgatgaaaagtcatgcttcatttttcttcacttcattagtggcattatctcttaagggcaatataatacctttgttgaaaacagaaataaagataatatcttaaagcaca

SEQ ID NO: 369413 - DNA, 563 bp, Homo sapiens
cagttattaataatatactgtggtaaaggttatatgaatgtagtttctctctcaaaatatgttattgtactgtgccacagctgactgaaaccacagataaggagtactgctgtagcagatactcttctgaggttcggggatatagcactgagtaagctagaagtggaatctttgtggagttcacagtccagcacagttgacaacaaataggtaatctcaggtgtgatgagttatgaaaggggacattcaaggtaatgtggaacatatgacaaggggcacagagaccttgactagctagtcccagaagatttccttccaccctgaggaagtgatatttagatcattcgacctggagaaaaaatagaagttagccctgaggtgaaagagagcaggctacactggaggcgctgaagaaagcataggacagctggagtgagcaagtaagtccatagtccagatgatagaggatcttgtaggtcatttgaaatactttggtccttatcccaaaagttgtaggaagtcacaggaagattttttccttaaaaaaaaaataaaaggtataa

SEQ ID NO: 369414 - DNA, 3975 bp, Homo sapiens
agtattgagagcgcgtgggagcataggcgcatgcgcgctcgtggggtgcgcggtagcaacagaggactcgacccggctggagctccggagagcgcgcgtgcgccgtcacgagctcggcgctgccggggccgcggtgtggaagcgagtattcgaccgccgtgcgggccgcggggatgttccgaaaggcccggcgggtgaacgtgcgcaagcggaacgactccgaagaggaagagcgggaacgcgatgaggagcaggagccgccgccgttgttgccgccgccgggcacgggcgaagaggcgggccccggtggcggcgacagggcccctggcggggagtcgctgctgggcccggggccgtcgccgccttccgcgctgaccccgggcctcggggctgaggccgggggcggcttccccggcggcgcggagcccggcaacgggctgaagccgcgcaagaggcctcgcgagaacaaagaggtgccccgggccagcctgctcagcttccaggacgaggaggaagaaaatgaagaagttttcaaagtgaagaaatcaagttatagcaaaaagatagtaaaattgctcaagaaggaatataaagaagatcttgaaaaatcgaagattaagacagaactcaactcatcagctgaaagtgaacaacctttggacaaaacaggacatgttaaggatacaaatcaagaagatggagttatcatcagtgaacatggtgaagatgaaatggatatggaaagtgaaaaagaggaagaaaagccaaagactggtggagctttttcaaatgctttatcttcattgaatgttcttcgtccaggagaaattccagatgcagcttttatacatgctgcaaggaaaaagcgccaaatggcccgagaattgggagatttcactcctcatgataatgagcctggtaaaggccgccttgttagagaagatgagaatgatgccagtgatgatgaagatgacgatgagaaacgccggatagttttttctgtgaaagaaaagtcacaaagacaaaaaattgctgaggaaataggaattgaggggagtgatgatgatgctttagtaactggagaacaggatgaagagctcagccgatgggaacaggagcagataaggaaaggaattaatatccctcaggttcaagccagtcaacccgcagaagtgaatatgtactaccagaacacttaccagacaatgccttacggctcatcctatggcattccttatagttatacggcctatggatcatcagatgccaaatctcaaaaaacagataatacagtccctttcaaaactcccagtaatgagatgactcccgttactattgatttggtaaagaaacagcttaaagacaggttggactccatgaaagaattgcacaaaacaaatcgacagcagcatgagaaacatctgcaaagccgagtggactctaccagggctattgaaagattagaagggtcttctgggggtattggtgaacggtataaatttttgcaagaaatgcgagggtatgtccaagacttgcttgagtgtttcagtgaaaaggtgccactgattaatgaacttgaatcagcaatacatcagctgtacaaacagcgagcttcccgccttgtccaaagacgacaagatgatattaaagatgaatcttcggagttttcaagccattcaaacaaagctctgatggcaccaaatcttgactcctttggacgcgatcgggcactgtatcaagagcatgcaaaacgtcgcattgcagagcgggaggccaggaggactcgtcgtagacaagccagagaacaaaccggtaagatggcagatcaccttgaaggcctttccagtgatgatgaagaaacttctacagatattactaatttcaatctggaaaaagatcgaatttcaaaagaatccggcaaagtttttgaagatgtccttgaaagtttctattcaattgactgtattaaatcacagtttgaagcatggcgttcaaaatactacacatcctacaaagatgcttacattggcctttgtttgccaaaattattcaaccccctcatacgacttcagctcctcacttggactcctcttgaggcaaaatgtcgtgactttgagaatatgctgtggtttgaatctttgctgttttatggttgtgaagaacgagagcaagaaaaagatgatgtagatgttgccctactacctaccattgtggaaaaggtgattcttcctaaactaacagtgatagctgaaaatatgtgggaccctttttctacaacacagacttcaagaatggtgggaattacactaaaattaatcaatggatatccttcagtagtgaatgcagaaaataaaaatacacaggtatacctaaaggcacttttattgagaatgagaagaactttagatgatgatgtatttatgcccttatatcccaaaaatgtcttagaaaataaaaattctgggccttacttgttttttcaacgacagttttggtcttcagttaagctgttaggcaattttcttcagtggtatggcattttctcaaataaaactctgcaagagttatcaatagatggtttattaaatcgatatattctcatggcttttcagaattcagaatatggagatgacagcatcaaaaaagcccaaaatgtaatcaattgtttccccaaacaatggttcatgaatctgaaaggagaaaggactatttctcagttagaaaacttttgccgataccttgtacacttagcggatacaatttatagaaatagtatcgggtgttctgatgtggaaaaaagaaatgcaagggaaaacataaaacagatagtaaaactccttgcaagtgttcgagctttggatcatgctatgtctgttgcaagtgaccacaatgtgaaagaatttaagtctttgatcgaaggaaaatagatctatgagactgaaaaacctatttgcttgattaccattcccaatgtgtaaattttgtatatatgtaaagtttcttaaactgtaaaatagcaattcttgttttaatacaaaaaacattatattcaatactgtgtccttaaatgatatttcttcagaatgaaaggaattcagattatttctaggagtctatgaatgttttctttactgcctgtcatactttgtttactgaagtattttgtatggtcatttaaattaaccctctcagttaattgtcccctgtaaacgatgtgtgcagtgtaaattgtgtaattatgcatatatatatttataccaccatggacttactttcacactgggaaatttgtggtgtttttccacagaggaagccttttaacagcagaaaattatccggtagcaaattgtcttagggaaattactacactgttgtaacaaaagggctggcaagtgactaaatgttcattaccttttggttagcgttgctatcactgtagctgtgctgccttaacattgagagttgagttgtggacttagtcattgagtgaatgttgaactttcttccttgaatcagcgttagagtcaaatgtgggtttaatgtgaatgctaaatgaatatgcaacatagtttcaaatggaacatagaaatttcacttttgaaaataataaacccacaacctaattgcatggttttgggctgaccgtcctgtctcattcatgattttactccctgcccagcttgcagatacatgcatttgaattttagtagtctgtcatatttaaaatcccacatatgtgagttaaatatgcaataaagaatacgccttgctgattagccacacccaggcaatttaatatccatggtcttctataatgtttataccacattgtaaatattcagagaacttgttttaaagtttatgctttctgattctgtgattttcaaaagaggaatttttttggaaattaaggactatcgtttgataattatatatgtaattaagatttagccaagcattaaattaatttttaaa

SEQ ID NO: 369415 - DNA, 3859 bp, Homo sapiens
agtattgagagcgcgtgggagcataggcgcatgcgcgctcgtggggtgcgcggtagcaacagaggactcgacccggctggagctccggagagcgcgcgtgcgccgtcacgagctcggcgctgccggggccgcggtgtggaagcgagtattcgaccgccgtgcgggccgcggggatgttccgaaaggcccggcgggtgaacgtgcgcaagcggaacgactccgaagaggaagagcgggaacgcgatgaggagcaggagccgccgccgttgttgccgccgccgggcacgggcgaagaggcgggccccggtggcggcgacagggcccctggcggggagtcgctgctgggcccggggccgtcgccgccttccgcgctgaccccgggcctcggggctgaggccgggggcggcttccccggcggcgcggagcccggcaacgggctgaagccgcgcaagaggcctcgcgagaacaaagaggtgccccgggccagcctgctcagcttccaggacgaggaggaagaaaatgaagaagttttcaaagtgaagaaatcaagttatagcaaaaagatagtaaaattgctcaagaaggaatataaagaagatcttgaaaaatcgaagattaagacagaactcaactcatcagctgaaagtgaacaacctttggacaaaacaggacatgttaaggatacaaatcaagaagatggagttatcatcagtgaacatggtgaagatgaaatggatatggaaagtgaaaaagaggaagaaaagccaaagactggtggagctttttcaaatgctttatcttcattgaatgttcttcgtccaggagaaattccagatgcagcttttatacatgctgcaaggaaaaagcgccaaatggcccgagaattgggagatttcactcctcatgataatgagcctggtaaaggccgccttgttagagaagatgagaatgatgccagtgatgatgaagatgacgatgagaaacgccggatagttttttctgtgaaagaaaagtcacaaagacaaaaaattgctgaggaaataggaattgaggggagtgatgatgatgctttagtaactggagaacaggatgaagagctcagccgatgggaacaggagcagataaggaaaggaattaatatccctcaggttcaagccagtcaacccgcagaagtgaatatgtactaccagaacacttaccagacaatgccttacggctcatcctatggcattccttatagttatacggcctatggatcatcagatgccaaatctcaaaaaacagataatacagtccctttcaaaactcccagtaatgagatgactcccgttactattgatttggtaaagaaacagcttaaagacaggttggactccatgaaagaattgcacaaaacaaatcgacagcagcatgagaaacatctgcaaagccgagtggactctaccagggctattgaaagattagaagggtcttctgggggtattggtgaacggtataaatttttgcaagaaatgcgagggtatgtccaagacttgcttgagtgtttcagtgaaaaggtgccactgattaatgaacttgaatcagcaatacatcagctgtacaaacagcgagcttcccgccttgtccaaagacgacaagatgatattaaagatgaatcttcggagttttcaagccattcaaacaaagctctgatggcaccaaatcttgactcctttggacgcgatcgggcactgtatcaagagcatgcaaaacgtcgcattgcagagcgggaggccaggagatcgaatttcaaaagaatccggcaaagtttttgaagatgtccttgaaagtttctattcaattgactgtattaaatcacagtttgaagcatggcgttcaaaatactacacatcctacaaagatgcttacattggcctttgtttgccaaaattattcaaccccctcatacgacttcagctcctcacttggactcctcttgaggcaaaatgtcgtgactttgagaatatgctgtggtttgaatctttgctgttttatggttgtgaagaacgagagcaagaaaaagatgatgtagatgttgccctactacctaccattgtggaaaaggtgattcttcctaaactaacagtgatagctgaaaatatgtgggaccctttttctacaacacagacttcaagaatggtgggaattacactaaaattaatcaatggatatccttcagtagtgaatgcagaaaataaaaatacacaggtatacctaaaggcacttttattgagaatgagaagaactttagatgatgatgtatttatgcccttatatcccaaaaatgtcttagaaaataaaaattctgggccttacttgttttttcaacgacagttttggtcttcagttaagctgttaggcaattttcttcagtggtatggcattttctcaaataaaactctgcaagagttatcaatagatggtttattaaatcgatatattctcatggcttttcagaattcagaatatggagatgacagcatcaaaaaagcccaaaatgtaatcaattgtttccccaaacaatggttcatgaatctgaaaggagaaaggactatttctcagttagaaaacttttgccgataccttgtacacttagcggatacaatttatagaaatagtatcgggtgttctgatgtggaaaaaagaaatgcaagggaaaacataaaacagatagtaaaactccttgcaagtgttcgagctttggatcatgctatgtctgttgcaagtgaccacaatgtgaaagaatttaagtctttgatcgaaggaaaatagatctatgagactgaaaaacctatttgcttgattaccattcccaatgtgtaaattttgtatatatgtaaagtttcttaaactgtaaaatagcaattcttgttttaatacaaaaaacattatattcaatactgtgtccttaaatgatatttcttcagaatgaaaggaattcagattatttctaggagtctatgaatgttttctttactgcctgtcatactttgtttactgaagtattttgtatggtcatttaaattaaccctctcagttaattgtcccctgtaaacgatgtgtgcagtgtaaattgtgtaattatgcatatatatatttataccaccatggacttactttcacactgggaaatttgtggtgtttttccacagaggaagccttttaacagcagaaaattatccggtagcaaattgtcttagggaaattactacactgttgtaacaaaagggctggcaagtgactaaatgttcattaccttttggttagcgttgctatcactgtagctgtgctgccttaacattgagagttgagttgtggacttagtcattgagtgaatgttgaactttcttccttgaatcagcgttagagtcaaatgtgggtttaatgtgaatgctaaatgaatatgcaacatagtttcaaatggaacatagaaatttcacttttgaaaataataaacccacaacctaattgcatggttttgggctgaccgtcctgtctcattcatgattttactccctgcccagcttgcagatacatgcatttgaattttagtagtctgtcatatttaaaatcccacatatgtgagttaaatatgcaataaagaatacgccttgctgattagccacacccaggcaatttaatatccatggtcttctataatgtttataccacattgtaaatattcagagaacttgttttaaagtttatgctttctgattctgtgattttcaaaagaggaatttttttggaaattaaggactatcgtttgataattatatatgtaattaagatttagccaagcattaaattaatttttaaa

SEQ ID NO: 369416 - DNA, 3052 bp, Homo sapiens
agtattgagagcgcgtgggagcataggcgcatgcgcgctcgtggggtgcgcggtagcaacagaggactcgacccggctggagctccggagagcgcgcgtgcgccgtcacgagctcggcgctgccggggccgcggtgtggaagcgagtattcgaccgccgtgcgggccgcggggatgttccgaaaggcccggcgggtgaacgtgcgcaagcggaacgactccgaagaggaagagcgggaacgcgatgaggagcaggagccgccgccgttgttgccgccgccgggcacgggcgaagaggcgggccccggtggcggcgacagggcccctggcggggagtcgctgctgggcccggggccgtcgccgccttccgcgctgaccccgggcctcggggctgaggccgggggcggcttccccggcggcgcggagcccggcaacgggctgaagccgcgcaagaggcctcgcgagaacaaagaggtgccccgggccagcctgctcagcttccaggacgaggaggaagaaaatgaagaagttttcaaagtgaagaaatcaagttatagcaaaaagatagtaaaattgctcaagaaggaatataaagaagatcttgaaaaatcgaagattaagacagaactcaactcatcagctgaaagtgaacaacctttggacaaaacaggacatgttaaggatacaaatcaagaagatggagttatcatcagtgaacatggtgaagatgaaatggatatggaaagtgaaaaagaggaagaaaagccaaagactggtggagctttttcaaatgctttatcttcattgaatgttcttcgtccaggagaaattccagatgcagcttttatacatgctgcaaggaaaaagcgccaaatggcccgagaattgggagatttcactcctcatgataatgagcctggtaaaggccgccttgttagagaagatgagaatgatgccagtgatgatgaagatgacgatgagaaacgccggatagttttttctgtgaaagaaaagtcacaaagacaaaaaattgctgaggaaataggaattgaggggagtgatgatgatgctttagtaactggagaacaggatgaagagctcagccgatgggaacaggagcagataaggaaaggaattaatatccctcaggttcaagccagtcaacccgcagaagtgaatatgtactaccagaacacttaccagacaatgccttacggctcatcctatggcattccttatagttatacggcctatggatcatcagatgccaaatctcaaaaaacagataatacagtccctttcaaaactcccagtaatgagatgactcccgttactattgatttggtaaagaaacagcttaaagacaggttggactccatgaaagaattgcacaaaacaaatcgacagcagcatgagaaacatctgcaaagccgagtggactctaccagggctattgaaagattagaagggtcttctgggggtattggtgaacggtataaatttttgcaagaaatgcgagggtatgtccaagacttgcttgagtgtttcagtgaaaaggtgccactgattaatgaacttgaatcagcaatacatcagctgtacaaacagcgagcttcccgccttgtccaaagacgacaagatgatattaaagatgaatcttcggagttttcaagccattcaaacaaagctctgatggcaccaaatcttgactcctttggacgcgatcgggcactgtatcaagagcatgcaaaacgtcgcattgcagagcgggaggccaggaggactcgtcgtagacaagccagagaacaaaccggtaagatggcagatcaccttgaaggcctttccagtgatgatgaagaaacttctacagatattactaatttcaatctggaaaaagatcgaatttcaaaagaatccggcaaagtttttgaagatgtccttgaaagtttctattcaattgactgtattaaatcacagtttgaagcatggcgttcaaaatactacacatcctacaaagatgcttacattggcctttgtttgccaaaattattcaaccccctcatacgacttcagctcctcacttggactcctcttgaggcaaaatgtcgtgactttgagaatatgctgtggtttgaatctttgctgttttatggttgtgaagaacgagagcaagaaaaagatgatgtagatgttgccctactacctaccattgtggaaaaggtgattcttcctaaactaacagtgatagctgaaaatatgtgggaccctttttctacaacacagacttcaagaatggtgggaattacactaaaattaatcaatggatatccttcagtagtgaatgcagaaaataaaaatacacaggtatacctaaaggcacttttattgagaatgagaagaactttagatgatgatgtatttatgcccttatatcccaaaaatgtcttagaaaataaaaattctgggccttacttgttttttcaacgacagttttggtcttcagttaagctgttaggcaattttcttcagtggtatggcattttctcaaataaaactctgcaagagttatcaatagatggtttattaaatcgatatattctcatggcttttcagaattcagaatatggagatgacagcatcaaaaaagcccaaaatgtaatcaattgtttccccaaacaatggttcatgaatctgaaaggagaaaggactatttctcagttagaaaacttttgccgataccttgtacacttagcggatacaatttatagaaatagtatcgggtgttctgatgtggaaaaaagaaatgcaagggaaaacataaaacagatagtaaaactccttgcaagtgttcgagctttggatcatgctatgtctgttgcaagtgaccacaatgtgaaagaatttaagtctttgatcgaaggaaaatagatctatgagactgaaaaacctatttgcttgattaccattcccaatgtgtaaattttgtatatatgtaaagtttcttaaactgtaaaatagcaattcttgttttaatacaaaaaacattatattca

SEQ ID NO: 369417 - DNA, 3205 bp, Homo sapiens
agtattgagagcgcgtgggagcataggcgcatgcgcgctcgtggggtgcgcggtagcaacagaggactcgacccggctggagctccggagagcgcgcgtgcgccgtcacgagctcggcgctgccggggccgcggtgtggaagcgagtattcgaccgccgtgcgggccgcggggatgttccgaaaggcccggcgggtgaacgtgcgcaagcggaacgactccgaagaggaagagcgggaacgcgatgaggagcaggagccgccgccgttgttgccgccgccgggcacgggcgaagaggcgggccccggtggcggcgacagggcccctggcggggagtcgctgctgggcccggggccgtcgccgccttccgcgctgaccccgggcctcggggctgaggccgggggcggcttccccggcggcgcggagcccggcaacgggctgaagccgcgcaagaggcctcgcgagaacaaagaggtgccccgggccagcctgctcagcttccaggacgaggaggaagaaaatgaagaagttttcaaagtgaagaaatcaagttatagcaaaaagatagtaaaattgctcaagaaggaatataaagaagatcttgaaaaatcgaagattaagacagaactcaactcatcagctgaaagtgaacaacctttggacaaaacaggacatgttaaggatacaaatcaagaagatggagttatcatcagtgaacatggtgaagatgaaatggatatggaaagtgaaaaagaggaagaaaagccaaagactggtggagctttttcaaatgctttatcttcattgaatgttcttcgtccaggagaaattccagatgcagcttttatacatgctgcaaggaaaaagcgccaaatggcccgagaattgggagatttcactcctcatgataatgagcctggtaaaggccgccttgttagagaagatgagaatgatgccagtgatgatgaagatgacgatgagaaacgccggatagttttttctgtgaaagaaaagtcacaaagacaaaaaattgctgaggaaataggaattgaggggagtgatgatgatgctttagtaactggagaacaggatgaagagctcagccgatgggaacaggagcagataaggaaaggaattaatatccctcaggttcaagccagtcaacccgcagaagtgaatatgtactaccagaacacttaccagacaatgccttacggctcatcctatggcattccttatagttatacggcctatggatcatcagatgccaaatctcaaaaaacagataatacagtccctttcaaaactcccagtaatgagatgactcccgttactattgatttggtaaagaaacagcttaaagacaggttggactccatgaaagaattgcacaaaacaaatcgacagcagcatgagaaacatctgcaaagccgagtggactctaccagggctattgaaagattagaagggtcttctgggggtattggtgaacggtataaatttttgcaagaaatgcgagggtatgtccaagacttgcttgagtgtttcagtgaaaaggtgccactgattaatgaacttgaatcagcaatacatcagctgtacaaacagcgagcttcccgccttgtccaaagacgacaagatgatattaaagatgaatcttcggagttttcaagccattcaaacaaagctctgatggcaccaaatcttgactcctttggacgcgatcgggcactgtatcaagagcatgcaaaacgtcgcattgcagagcgggaggccaggaggactcgtcgtagacaagccagagaacaaaccggtaagatggcagatcaccttgaaggcctttccagtgatgatgaagaaacttctacagatattactaatttcaatctggaaaaagatcgaatttcaaaagaatccggcaaagtttttgaagatgtccttgaaagtttctattcaattgactgtattaaatcacagtttgaagcatggcgttcaaaatactacacatcctacaaagatgcttacattggcctttgtttgccaaaattattcaaccccctcatacgacttcagctcctcacttggactcctcttgaggcaaaatgtcgtgactttgagaatatgctgtggtttgaatctttgctgttttatggttgtgaagaacgagagcaagaaaaagatgatgtagatgttgccctactacctaccattgtggaaaaggtgattcttcctaaactaacagtgatagctgaaaatatgtgggaccctttttctacaacacagacttcaagaatggtgggaattacactaaaattaatcaatggatatccttcagtagtgaatgcagaaaataaaaatacacaggtatacctaaaggcacttttattgagaatgagaagaactttagatgatgatgtatttatgcccttatatcccaaaaatgtcttagaaaataaaaattctgggccttacttgttttttcaacgacagttttggtcttcagttaagctgttaggcaattttcttcagtggtatggcattttctcaaataaaactctgcaagagttatcaatagatggtttattaaatcgatatattctcatggcttttcagaattcagaatatggagatgacagcatcaaaaaagcccaaaatgtgagttaaatgcatagtacagtttttaaagcatataatttaaaatgaattaagtttttgtttgtttgaagagggatttgagaattttatgaaacccctttgattactggacttgcatgtaaggttgacagtttgcctacccaggtagttccaaccccctacagcattttttacataaaaatgcatactgttatatatatatatatccatctatatccatatttttatagatattagtgaaagttttgatatttttataggtataaataaaagttttgatttcagaataataaccttattatcttaacctcagtctgggccaactcgacttcccttagcagcatgcatggatgtctattcgtggaattattgcaggggatgggggtgctgtaatttcatttttataccactcatttttacatcaaaagctgctggaaaaggaaattcagtatatttaggccatcctagaagactggaaaatgaagcagttggttgtcagttttatgttactaatttactcaaatattggacagattatcttttgctttgag

SEQ ID NO: 369418 - DNA, 416 bp, Homo sapiens
aacagacatagccagagaataataggtatctacccattcccataacccagttaaatttcacttataacctttcagagttacatactgcttttttcccatttacagagaattcatcattctccttgctattttttccttcctaatagctaataacggatcatttcttcccttttgtttatgcccactcccttttgattggtcttcaaatacagagtaatgacctctgggtaaagatggggcttgaacactagggtatagtttcactctctcccaaaaaccacactgaaatgatggtagaggttttgttcatgacggtggtattttttgtttttaagcacaaacctaaaagaatgggaaaaaagaaaaagggaaccaccatggaatttttaaagtggcagcagatgaataaatactta

SEQ ID NO: 369419 - DNA, 198 bp, Homo sapiens
tctgtgtcatccctgatatcaatagagaaaaggaagtgtttggcactttgagagggaatttggtgttgtgtggaatatcagctctgttaatacctggcttggaccttgatcaaggcactaaaatctcctttggtcctagatcttatctataaatgtctaggtttcattatctatcagtaaagatatatgcatatccac

SEQ ID NO: 369420 - DNA, 370 bp, Homo sapiens
ttttctttgttatggaaaaacgcccatttgttacagaaacattagagtgtacaaatatgccaaaaaggaaagagaaaggaagagtggcccatgaccccaccactcagaaataacttatgatttttctctgtattacagatttgcatatatgtgcttttaaaataaaaatgaaataatactgtctatattgtcttgtgacctgcttttttcaatgtgctataccatgaatttttccatgtcaataaatttgcttctataaaataatacttagggcctgtatgctattcaattttatgaatatgttataacttttaaactgacttctttctgttaagtaatagtacaataaaggtttttatagtaaaatatt

SEQ ID NO: 369421 - DNA, 698 bp, Homo sapiens
gcggccgcgcgcgcggacatgggggagaagctggagctgagactgaagtcgcccgtgggggctgagcccgccgtctacccgtggccgctgccggtctacgataaacatcacgatgctgctcatgaaatcatcgagaccatccgatgggtctgtgaagaaatcccggatctcaagctcgctatggagaattacgttttaattgactatgacaccaaaagcttcgagagcatgcagaggctctgcgacaagtacaaccgtgccatcgacagcatccaccagctgtggaagggcaccacgcagcccatgaagctgaacacgcggccgtccactggactcctgcgccatatcctgcagcaggtctacaaccactcggtgaccgaccccgagaagctcaacaactacgagcccttctcccccgaggtgtacggggagacctccttcgacctggtggcccagatgattgatgagatcaagatgaccgacgacgacctgtttgtggacttggggagcggtgtgggccaggtcgtgctccaggttgctgctgccaccaactgcaaacatcactatggcgtcgagaaagcagacatcccggccaagtatgcggagaccatggaccgcgagttcaggaagtggatgaaatggtatggaaaaaagcatgcagaatacacagtgagtgccatcgctccgccccggctccc

SEQ ID NO: 369422 - DNA, 6802 bp, Homo sapiens
gcggccgcgcgcgcggacatgggggagaagctggagctgagactgaagtcgcccgtgggggctgagcccgccgtctacccgtggccgctgccggtctacgataaacatcacgatgctgctcatgaaatcatcgagaccatccgatgggtctgtgaagaaatcccggatctcaagctcgctatggagaattacgttttaattgactatgacaccaaaagcttcgagagcatgcagaggctctgcgacaagtacaaccgtgccatcgacagcatccaccagctgtggaagggcaccacgcagcccatgaagctgaacacgcggccgtccactggactcctgcgccatatcctgcagcaggtctacaaccactcggtgaccgaccccgagaagctcaacaactacgagcccttctcccccgaggtgtacggggagacctccttcgacctggtggcccagatgattgatgagatcaagatgaccgacgacgacctgtttgtggacttggggagcggtgtgggccaggtcgtgctccaggttgctgctgccaccaactgcaaacatcactatggcgtcgagaaagcagacatcccggccaagtatgcggagaccatggaccgcgagttcaggaagtggatgaaatggtatggaaaaaagcatgcagaatacacattggagagaggcgatttcctctcagaagagtggagggagcgaatcgccaacacgagtgttatatttgtgaataattttgcctttggtcctgaggtggatcaccagctgaaggagcggtttgcaaacatgaaggaaggtggcagaatcgtgtcctcgaaaccctttgcacctctgaacttcagaataaacagtagaaacttgagtgacatcggcaccatcatgcgcgtggtggagctctcgcccctgaagggctcggtgtcgtggacggggaagccagtctcctactacctgcacactatcgaccgcaccatacttgaaaactatttttctagtctgaaaaacccaaaactcagggaggaacaggaggcagcccggcgccgccagcagcgcgagagcaagagcaacgcggcacgcccactaagggcccagagggcaaggtggccggccccgccgacgcccccatggactctggtgctgaggaagagaaggcgggagcagccaccgtgaagaagccgtctccctccaaagcccgcaagaagaagctaaacaagaaggggaggaagatggctggccgcaagcgcgggcgccccaagaagatgaacactgcgaaccccgagcggaagcccaagaagaaccaaagtgcagcggcactcccccaacccgctgctggtggcgcccaccccgcccgcgctgcagaagcttctagagtccttcaagatccagtacctgcagttcctggcatacacaaagaccccccagtacaaggccagcctgcaggagctgctgggccaggagaaggagaagaacgcccagctcctgggtgcggctcagcagctcctcagccactgccaggcccagaaggaggagatcaggaggctgtttcagcaaaaattggatgagctgggtgtgaaggcgctgacctacaacgacctgattcaagcgcagaaggagatctccgcccataaccagcagctgcgggagcagtcggagcagctggagcaggacaaccgcgcgctccgcggccagagcttgcagctgctcaaggctcgctgcgaggagctgcagctggactgggccacgctgtcgctggagaagctgttgaaggagaagcaggccctgaagagccagatctcggagaagcagaggcactgcctggagctgcagatcagcattgtggagctagagaagagccagcggcagcaggagctcctgcagctcaagtcctgtgtgccgcctgacgacgccctgtccctgcacctgcgtgggaagggcgccctgggccgcgagctggagcctgacgccagccggctgcacctggagctggactgcaccaagttctcgctgcctcacttgagcagcatgagcccggagctctccatgaacggccaggctgctggctatgagctctgcggtgtgctgagccggccttcgtcgaagcagaacacgccccagtacctggcctcacccctggaccaggaggtggtgccctgtacccctagccacgtcggccggccgcgcctggagaagctgtctggcctagccgcacccgactacactaggctgtccccggccaagattgtgctgaggcggcacctgagccaggaccacacggtgcccggcaggccggctgccagtgagctgcattcgagagctgagcacaccaaggagaacggccttccctaccagagccccagcgtgcctggcagcatgaagctgagccctcaggacccgcggcccctgtcccctggggccttgcagcttgctggagagaagagcagtgagaagggcctgagagagcgcgcctacggcagcagcggggagctcatcaccagcctgcccatcagcatcccgctcagcaccgtgcagcccaacaagctcccggtcagcattcccctggccagcgtggtgctgcccagccgcgccgagagggcgaggagcacccccagtcccgtgctgcagccccgtgacccctcgtccacacttgaaaagcagattggtgctaatgcccacggtgctgggagcagaagccttgccctggcccccgcaggcttctcctacgctggctcggtggccatcagcggggccttggcgggcagcccggcctctctcacacctggagccgagccggccaccttggatgagtcctccagctctgggagcctttttgccaccgtggggtcccgcagctccacgccacagcaccccctgctgctggcacagccccggaactcgcttcctgcctctcccgcccaccagctctcctccagtccccggcttggtggggccgcccagggcccgttgcccgaggccagcaagggagacctgccctccgattccggcttctcagatcctgagagtgaagccaagaggaggattgtgttcaccatcaccactggtgcgggcagtgccaagcagtcgccctccagcaagcacagccccctgaccgccagcgcccgtggggactgtgtgccgagccacgggcaggacagtcgcaggcgcggccggcggaagcgagcatctgcggggacgcccagcttgagcgcaggcgtgtcccccaagcgccgagccctgccgtccgtcgctggccttttcacacagccttcggggtctcccctcaacctcaactccatggtcagtaacatcaaccagcccctggagattacagccatctcgtccccggagacctccctgaagagctcccctgtgccctaccaggaccacgaccagccccccgtgctcaagaaggagcggcctctgagccagaccaatggggcacactactccccactcacctcagacgaggagccaggctctgaggacgagcccagcagtgctcgaattgagagaaaaattgcaacaatctccttagaaagcaaatctcccccgaaaaccttggaaaatggtggtggcttggcgggaaggaagcccgcgcccgccggcgagccagtcaatagcagcaagtggaagtccaccttctcgcccatctccgacatcggcctggccaagtcggcggacagcccgctgcaggccagctccgccctcagccagaactccctgttcacgttccggcccgccctggaggagccctctgccgatgccaagctggccgctcaccccaggaaaggctttcccggctccctgtcgggggctgacggactcagcccgggcaccaaccctgccaacggctgcaccttcggcgggggcctggccgcggacctgagtttacacagcttcagtgatggtgcttctcttccccacaagggccccgaggcggccggcctgagctccccgctgagcttcccctcgcagcgcggcaaggagggctcggacgccaaccctttcctgagcaagaggcagctggacggcctggctgggctgaagggcgagggcagccgcggcaaggaggcaggggagggcggcctaccgctgtgcgggcccacggacaagaccccactgctgagcggcaaggccgccaaggcccgggaccgcgaggtcgacctcaagaatggccacaacctcttcatctctgcggcggccgtgcctcccggaagcctcctcagcggccccggcctggccccggcggcgtcctccgcaggcggcgcggcgtcctccgcccagacgcaccggtccttcctgggccccttcccgccgggaccgcagttcgcgctcggccccatgtccctgcaggccaacctcggctccgtggccggctcctccgtgctgcagtcgctgttcagctctgtgccggccgccgcaggcctggtgcacgtgtcgtccgctgccaccagactgaccaactcgcacgccatgggcagcttttccggggtggcaggcggcacagttggaggtgtctttaaccacgcggtgccctccgcctctgctcatccgtttggagcccgtgtcggccgcggggctgcatgtggcagcgccacactgggcccgagcccgctgcaggcggcggccagcgcctcggcctcttcctttcaggccccggcctcggttgagacccggccgccccctccgcctccgcctccgcctcccccgctgcccccgcctgcgcacctgggccggtcccccgcggggccgcccgtcctccacgccccccctccacctaacgccgccttgcctcctcccccaacgctgctggcctctaaccctgagcccgcgcttctgcagagcctcgcgtccctcccgcctaaccaagctttcttgccccccacctctgctgcctctctgccgcctgctaacgcctctttgtctatcaagctcacctccctcccgcacaagggcgcccgcccctccttcacggtgcaccaccagcccctgccccggctggccctggcccaggccgcgcccgggatcccacaggccagcgccacggggccgtccgcggtgtgggtgtccctcggcatgccgcctccctatgccgcgcacctttcgggggttaagccgcgataaagaccttgcttagctagcagtgcgtattgtgtaaggtaaggccagagccctgcgcggtggctcactccagacactgaactgtccttcctttggcagagaagacggccacagggctcggcagaagttccgggggtcctgaggagggaagagggagagagccagggagaccagggagatggtcgcgagaggagggactacaggacgggcaccagccatggagtggcctgagtgtgttgggttccagctgcccgcagctgggttcctgcggtgacgccgcaggactgaggccagccctgggggcagctgtgccagcccctgtgggcgaggctcacggggtgccaggccagggggctgggagctctagctcctagagcagtctccagggctccatccgcaccaggcccaggtcactcatgacgggtggcgtggcttggtgctgttccccaggcgcccagcatgtagcaggcacggtgccggctgcagaggtcctggagagccagggtggctggctggatgcctctggtcggggctgtctggccagtagcctcggatgccctcatagggagccagtgaagccccaagtgccctgcctgcctgggggctgatgggttcccggcggggtcgagaggcaagctctgtgccctgcgtgttgaggcccccttgctggacacggctgatggccacactgccctgtggtcatggcccacagccgaggggctttcagctgctcagatgtcagcaccaagctgggcaggttagtgtagacggtgcccacctttgagaccagaaggaagttggaagcaggagtgattttgatgatgtgaggccttcagggaatgtcctgttcactcctcccccaagaggctgtggagactgtggccgctgacccctgagggcagttggccacccgtgccctccagggacatggcgtgcctggcggcgtagtgcaaaggtgccctctgcttgcccctggccttctgcctcaggggcccctgggacacaggccttcctgggcgagtccaaagcccaccgggcaaggagaggaggactgggagccaggagccaaggcggaggctgtggccagggctggtcagcctggcgggtcaatgcgggcacctgcgggctggacaagctatgctgggtctcttaggagatgagctgcaggtagggtggctttagctggactcggctgtgtgtctcctttggaggaaggctggagcttggccggcgtgtccaggtgtcaggctccctggtctgtcacggggcacgcccgtcgtctgttgtggttagaggagctggcactatgcctgtcatggtgctggccccaggtggcgtgtgtgctcgtgggaggcctcggtccccagcctgggtgagtgttgggctcccccaggcgcgatggtaacctcaggccgctcttcccgctgtgcccttctgcaggtaactaggatttctacctcaaccgcgagacctatgcaaggacggtgtggaccaactcgcgcccgcggcatggtgcccgccggcctgccgggctcccacccctggacggcagaggcaaggacggacgggagctccactgtgaatcggcggcacgcgccgcaggaggctgggactggtccagtttgtactgtcgatagttttagataaagtatttatcattttttaaaaagtataaaca

SEQ ID NO: 369423 - DNA, 7425 bp, Homo sapiens
gcggccgcgcgcgcggacatgggggagaagctggagctgagactgaagtcgcccgtgggggctgagcccgccgtctacccgtggccgctgccggtctacgataaacatcacgatgctgctcatgaaatcatcgagaccatccgatgggtctgtgaagaaatcccggatctcaagctcgctatggagaattacgttttaattgactatgacaccaaaagcttcgagagcatgcagaggctctgcgacaagtacaaccgtgccatcgacagcatccaccagctgtggaagggcaccacgcagcccatgaagctgaacacgcggccgtccactggactcctgcgccatatcctgcagcaggtctacaaccactcggtgaccgaccccgagaagctcaacaactacgagcccttctcccccgaggtgtacggggagacctccttcgacctggtggcccagatgattgatgagatcaagatgaccgacgacgacctgtttgtggacttggggagcggtgtgggccaggtcgtgctccaggttgctgctgccaccaactgcaaacatcactatggcgtcgagaaagcagacatcccggccaagtatgcggagaccatggaccgcgagttcaggaagtggatgaaatggtatggaaaaaagcatgcagaatacacattggagagaggcgatttcctctcagaagagtggagggagcgaatcgccaacacgagtgttatatttgtgaataattttgcctttggtcctgaggtggatcaccagctgaaggagcggtttgcaaacatgaaggaaggtggcagaatcgtgtcctcgaaaccctttgcacctctgaacttcagaataaacagtagaaacttgagtgacatcggcaccatcatgcgcgtggtggagctctcgcccctgaagggctcggtgtcgtggacggggaagccagtctcctactacctgcacactatcgaccgcaccatacttgaaaactatttttctagtctgaaaaacccaaaactcagggaggaacaggaggcagcccggcgccgccagcagcgcgagagcaagagcaacgcggcacgcccactaagggcccagagggcaaggtggccggccccgccgacgcccccatggactctggtgctgaggaagagaaggcgggagcagccaccgtgaagaagccgtctccctccaaagcccgcaagaagaagctaaacaagaaggggaggaagatggctggccgcaagcgcgggcgccccaagaagatgaacactgcgaaccccgagcggaagcccaagaagaaccaaactgcactggatgccctgcacgctcagaccgtgtctcagacggcggcctcctcaccccaggatgcctacagatcccctcacagcccgttctaccagctacctccgagcgtgcagcggcactcccccaacccgctgctggtggcgcccaccccgcccgcgctgcagaagcttctagagtccttcaagatccagtacctgcagttcctggcatacacaaagaccccccagtacaaggccagcctgcaggagctgctgggccaggagaaggagaagaacgcccagctcctgggtgcggctcagcagctcctcagccactgccaggcccagaaggaggagatcaggaggctgtttcagcaaaaattggatgagctgggtgtgaaggcgctgacctacaacgacctgattcaagcgcagaaggagatctccgcccataaccagcagctgcgggagcagtcggagcagctggagcaggacaaccgcgcgctccgcggccagagcttgcagctgctcaaggctcgctgcgaggagctgcagctggactgggccacgctgtcgctggagaagctgttgaaggagaagcaggccctgaagagccagatctcggagaagcagaggcactgcctggagctgcagatcagcattgtggagctagagaagagccagcggcagcaggagctcctgcagctcaagtcctgtgtgccgcctgacgacgccctgtccctgcacctgcgtgggaagggcgccctgggccgcgagctggagcctgacgccagccggctgcacctggagctggactgcaccaagttctcgctgcctcacttgagcagcatgagcccggagctctccatgaacggccaggctgctggctatgagctctgcggtgtgctgagccggccttcgtcgaagcagaacacgccccagtacctggcctcacccctggaccaggaggtggtgccctgtacccctagccacgtcggccggccgcgcctggagaagctgtctggcctagccgcacccgactacactaggctgtccccggccaagattgtgctgaggcggcacctgagccaggaccacacggtgcccggcaggccggctgccagtgagctgcattcgagagctgagcacaccaaggagaacggccttccctaccagagccccagcgtgcctggcagcatgaagctgagccctcaggacccgcggcccctgtcccctggggccttgcagcttgctggagagaagagcagtgagaagggcctgagagagcgcgcctacggcagcagcggggagctcatcaccagcctgcccatcagcatcccgctcagcaccgtgcagcccaacaagctcccggtcagcattcccctggccagcgtggtgctgcccagccgcgccgagagggcgaggagcacccccagtcccgtgctgcagccccgtgacccctcgtccacacttgaaaagcagattggtgctaatgcccacggtgctgggagcagaagccttgccctggcccccgcaggcttctcctacgctggctcggtggccatcagcggggccttggcgggcagcccggcctctctcacacctggagccgagccggccaccttggatgagtcctccagctctgggagcctttttgccaccgtggggtcccgcagctccacgccacagcaccccctgctgctggcacagccccggaactcgcttcctgcctctcccgcccaccagctctcctccagtccccggcttggtggggccgcccagggcccgttgcccgaggccagcaagggagacctgccctccgattccggcttctcagatcctgagagtgaagccaagaggaggattgtgttcaccatcaccactggtgcgggcagtgccaagcagtcgccctccagcaagcacagccccctgaccgccagcgcccgtggggactgtgtgccgagccacgggcaggacagtcgcaggcgcggccggcggaagcgagcatctgcggggacgcccagcttgagcgcaggcgtgtcccccaagcgccgagccctgccgtccgtcgctggccttttcacacagccttcggggtctcccctcaacctcaactccatggtcagtaacatcaaccagcccctggagattacagccatctcgtccccggagacctccctgaagagctcccctgtgccctaccaggaccacgaccagccccccgtgctcaagaaggagcggcctctgagccagaccaatggggcacactactccccactcacctcagacgaggagccaggctctgaggacgagcccagcagtgctcgaattgagagaaaaattgcaacaatctccttagaaagcaaatctcccccgaaaaccttggaaaatggtggtggcttggcgggaaggaagcccgcgcccgccggcgagccagtcaatagcagcaagtggaagtccaccttctcgcccatctccgacatcggcctggccaagtcggcggacagcccgctgcaggccagctccgccctcagccagaactccctgttcacgttccggcccgccctggaggagccctctgccgatgccaagctggccgctcaccccaggaaaggctttcccggctccctgtcgggggctgacggactcagcccgggcaccaaccctgccaacggctgcaccttcggcgggggcctggccgcggacctgagtttacacagcttcagtgatggtgcttctcttccccacaagggccccgaggcggccggcctgagctccccgctgagcttcccctcgcagcgcggcaaggagggctcggacgccaaccctttcctgagcaagaggcagctggacggcctggctgggctgaagggcgagggcagccgcggcaaggaggcaggggagggcggcctaccgctgtgcgggcccacggacaagaccccactgctgagcggcaaggccgccaaggcccgggaccgcgaggtcgacctcaagaatggccacaacctcttcatctctgcggcggccgtgcctcccggaagcctcctcagcggccccggcctggccccggcggcgtcctccgcaggcggcgcggcgtcctccgcccagacgcaccggtccttcctgggccccttcccgccgggaccgcagttcgcgctcggccccatgtccctgcaggccaacctcggctccgtggccggctcctccgtgctgcagtcgctgttcagctctgtgccggccgccgcaggcctggtgcacgtgtcgtccgctgccaccagactgaccaactcgcacgccatgggcagcttttccggggtggcaggcggcacagttggaggtaactaggatttctacctcaaccgcgagacctatgcaaggacggtgtggaccaactcgcgcccgcggcatggtgcccgccggcctgccgggctcccacccctggacggcagaggcaaggacggacgggagctccactgtgaatcggcggcacgcgccgcaggaggctgggactggtccagtttgtactgtcgatagttttagataaagtatttatcattttttaaaaagtataaacaattctgacttattttattccatctaagtggtaaaaggcaacttattgagaaatataaatatctatatatgagagctctatataaagacacgtgtctgcagggcgggcccgccagcggattcgccacagcctgccccggtgctatctcgtccccaggcccgcgcctgcctccacccgcttggtgctgactagacgctgacaacgccgaaccccgttctcggaaacgccgcccggccggctcccccgacgcgctgctcccgtaccaaaggcaggcccgtcgccaccacattcctcggaggcctccccgcggcctgagccccttcctgagcgccctggcgcctgccctgagctcttcacctttaccccggcactgtgaacccccagactgttcaccctccggggcgtgggttgcgcccttgcatgtgaaggggcctgcgcggtgacgcagctggccatgtgctgcgcgatggtgctgtgaggacggcgcgggcacgttgaacaagtgcatttacttttgtatttctcggctgtccatggctcgcagcatgccctgcgatgcggggcaggcctgtcgtgggtcccttggtgtttctgtacaggagagagtcacactaatgagtggcagtattttatagagatgtgatgagaatttataaatttcatagatttgacagcttttatttttagatggtataatgcacagtgaagaggaaagaaaagcgaggggaaaaaaccttatttattcaaacagtgcacaaaatggccccagcgtcagccccgaccctagacccctcagttgcagctcccagcagcccagacagagctgccggcgcccctgcctgccccacatcccttcctgtcagggccacgcctggcacccatcccttggagcctgtgctggttctcccagctgctgtgggtgtgctggggccagggtgcactgctgaaacctggcctctctggccctaggccccagggtgacgtcggccccccactctgcagccttggcgggtgcctgggactgggtgtggaaggagaggagctgaggccggggtgtagcaggcaggcagggccactccagtgcttctggagccctgagcagtcagggcctgggttgtctgagcagtggtggctctgtgccctccctggaggatgggatctgggagtctgagctccccgcatctggccctgggctgtgtggcacttgctgagcccaccttctcaagtgcttgctcctgtgagatggcatcggggagccccttccccaaggtgccacagatccaccctccagggagctgccagccctgtgttctggttcccaagggcaggatggacacacgtcacatccctaccacgtggcctccaaagggagccacggaggaaaggcttctgtggttgctaggtgggggagtcctgtgtgggagggcctgaagacccctgcttgtgcctggtgaggggggtgctgcctcccccagcccccaacaacctctcagacccccaccctccaacatagctgagttctgaagatggtgctccggacctgtcctcttaagtggtgcccagtgccctccccaccccacgttggtgctctcagctagaaggtgctgtgcctctgcctgagccccaagccccgagcctggccttcaggacaggcagcctgctctgtgtcgccacgggccggatacgccacagggttgatggcagagacggccgagtccctggtctagaacaagacacattctttaaacactgtattacttctgcctccctctaggtgacagtggcagtccgggtgccatcacgggtcctgcagatggccatgcagggctcctgcccacgcaggccaccgtatgttcaggacacgcactgggtctcagagccactggcccaggcagaagtctccttgagcccactgggtcatatgcgtgtcaccacacgtgaactagtgtggtggctgcctgcggacaccctcctgttctgagccctgggcctgtgttcttctcagacactcccagactgaggggtggtgtgtggcgggtggcagggtggctgtggagactggggatctggagcctggtgctggcacctggcctgagtttccgtgggcagctggcggggacctgtgctgctgctgctgactgtgggtgggcgggcggcgcctgggagtggctcttgctcaggaattgataggaaccctaaaaactaggataccccctcctcggcccatgaggcacgcacagtgacttatttaagacttcccccttaatttatctgcccccaggatgcgtcagtctgttcagtggtcagcaggccccccaccccccgccgactgccctcgccatcgtggtcagacccccctcccaacacaacacgctgctggtctgtgtcagcctttgtaacgtgggaggctctgccgtgtcttccgggtgaactgtatttggattgcgcgcattgtcacggtccgcccctgggctgcaggcgccccttcctctgggcacccctgcattctgcatccccacctctagacgctgtaataaacagactgttttcactcggaaaaaaaat

SEQ ID NO: 369424 - DNA, 7964 bp, Homo sapiens
gcggccgcgcgcgcggacatgggggagaagctggagctgagactgaagtcgcccgtgggggctgagcccgccgtctacccgtggccgctgccggtctacgataaacatcacgatgctgctcatgaaatcatcgagaccatccgatgggtctgtgaagaaatcccggatctcaagctcgctatggagaattacgttttaattgactatgacaccaaaagcttcgagagcatgcagaggctctgcgacaagtacaaccgtgccatcgacagcatccaccagctgtggaagggcaccacgcagcccatgaagctgaacacgcggccgtccactggactcctgcgccatatcctgcagcaggtctacaaccactcggtgaccgaccccgagaagctcaacaactacgagcccttctcccccgaggtgtacggggagacctccttcgacctggtggcccagatgattgatgagatcaagatgaccgacgacgacctgtttgtggacttggggagcggtgtgggccaggtcgtgctccaggttgctgctgccaccaactgcaaacatcactatggcgtcgagaaagcagacatcccggccaagtatgcggagaccatggaccgcgagttcaggaagtggatgaaatggtatggaaaaaagcatgcagaatacacattggagagaggcgatttcctctcagaagagtggagggagcgaatcgccaacacgagtgttatatttgtgaataattttgcctttggtcctgaggtggatcaccagctgaaggagcggtttgcaaacatgaaggaaggtggcagaatcgtgtcctcgaaaccctttgcacctctgaacttcagaataaacagtagaaacttgagtgacatcggcaccatcatgcgcgtggtggagctctcgcccctgaagggctcggtgtcgtggacggggaagccagtctcctactacctgcacactatcgaccgcaccatacttgaaaactatttttctagtctgaaaaacccaaaactcagggaggaacaggaggcagcccggcgccgccagcagcgcgagagcaagagcaacgcggcacgcccactaagggcccagagggcaaggtggccggccccgccgacgcccccatggactctggtgctgaggaagagaaggcgggagcagccaccgtgaagaagccgtctccctccaaagcccgcaagaagaagctaaacaagaaggggaggaagatggctggccgcaagcgcgggcgccccaagaagatgaacactgcgaaccccgagcggaagcccaagaagaaccaaagtgcagcggcactcccccaacccgctgctggtggcgcccaccccgcccgcgctgcagaagcttctagagtccttcaagatccagtacctgcagttcctggcatacacaaagaccccccagtacaaggccagcctgcaggagctgctgggccaggagaaggagaagaacgcccagctcctgggtgcggctcagcagctcctcagccactgccaggcccagaaggaggagatcaggaggctgtttcagcaaaaattggatgagctgggtgtgaaggcgctgacctacaacgacctgattcaagcgcagaaggagatctccgcccataaccagcagctgcgggagcagtcggagcagctggagcaggacaaccgcgcgctccgcggccagagcttgcagctgctcaaggctcgctgcgaggagctgcagctggactgggccacgctgtcgctggagaagctgttgaaggagaagcaggccctgaagagccagatctcggagaagcagaggcactgcctggagctgcagatcagcattgtggagctagagaagagccagcggcagcaggagctcctgcagctcaagtcctgtgtgccgcctgacgacgccctgtccctgcacctgcgtgggaagggcgccctgggccgcgagctggagcctgacgccagccggctgcacctggagctggactgcaccaagttctcgctgcctcacttgagcagcatgagcccggagctctccatgaacggccaggctgctggctatgagctctgcggtgtgctgagccggccttcgtcgaagcagaacacgccccagtacctggcctcacccctggaccaggaggtggtgccctgtacccctagccacgtcggccggccgcgcctggagaagctgtctggcctagccgcacccgactacactaggctgtccccggccaagattgtgctgaggcggcacctgagccaggaccacacggtgcccggcaggccggctgccagtgagctgcattcgagagctgagcacaccaaggagaacggccttccctaccagagccccagcgtgcctggcagcatgaagctgagccctcaggacccgcggcccctgtcccctggggccttgcagcttgctggagagaagagcagtgagaagggcctgagagagcgcgcctacggcagcagcggggagctcatcaccagcctgcccatcagcatcccgctcagcaccgtgcagcccaacaagctcccggtcagcattcccctggccagcgtggtgctgcccagccgcgccgagagggcgaggagcacccccagtcccgtgctgcagccccgtgacccctcgtccacacttgaaaagcagattggtgctaatgcccacggtgctgggagcagaagccttgccctggcccccgcaggcttctcctacgctggctcggtggccatcagcggggccttggcgggcagcccggcctctctcacacctggagccgagccggccaccttggatgagtcctccagctctgggagcctttttgccaccgtggggtcccgcagctccacgccacagcaccccctgctgctggcacagccccggaactcgcttcctgcctctcccgcccaccagctctcctccagtccccggcttggtggggccgcccagggcccgttgcccgaggccagcaagggagacctgccctccgattccggcttctcagatcctgagagtgaagccaagaggaggattgtgttcaccatcaccactggtgcgggcagtgccaagcagtcgccctccagcaagcacagccccctgaccgccagcgcccgtggggactgtgtgccgagccacgggcaggacagtcgcaggcgcggccggcggaagcgagcatctgcggggacgcccagcttgagcgcaggcgtgtcccccaagcgccgagccctgccgtccgtcgctggccttttcacacagccttcggggtctcccctcaacctcaactccatggtcagtaacatcaaccagcccctggagattacagccatctcgtccccggagacctccctgaagagctcccctgtgccctaccaggaccacgaccagccccccgtgctcaagaaggagcggcctctgagccagaccaatggggcacactactccccactcacctcagacgaggagccaggctctgaggacgagcccagcagtgctcgaattgagagaaaaattgcaacaatctccttagaaagcaaatctcccccgaaaaccttggaaaatggtggtggcttggcgggaaggaagcccgcgcccgccggcgagccagtcaatagcagcaagtggaagtccaccttctcgcccatctccgacatcggcctggccaagtcggcggacagcccgctgcaggccagctccgccctcagccagaactccctgttcacgttccggcccgccctggaggagccctctgccgatgccaagctggccgctcaccccaggaaaggctttcccggctccctgtcgggggctgacggactcagcccgggcaccaaccctgccaacggctgcaccttcggcgggggcctggccgcggacctgagtttacacagcttcagtgatggtgcttctcttccccacaagggccccgaggcggccggcctgagctccccgctgagcttcccctcgcagcgcggcaaggagggctcggacgccaaccctttcctgagcaagaggcagctggacggcctggctgggctgaagggcgagggcagccgcggcaaggaggcaggggagggcggcctaccgctgtgcgggcccacggacaagaccccactgctgagcggcaaggccgccaaggcccgggaccgcgaggtcgacctcaagaatggccacaacctcttcatctctgcggcggccgtgcctcccggaagcctcctcagcggccccggcctggccccggcggcgtcctccgcaggcggcgcggcgtcctccgcccagacgcaccggtccttcctgggccccttcccgccgggaccgcagttcgcgctcggccccatgtccctgcaggccaacctcggctccgtggccggctcctccgtgctgcagtcgctgttcagctctgtgccggccgccgcaggcctggtgcacgtgtcgtccgctgccaccagactgaccaactcgcacgccatgggcagcttttccggggtggcaggcggcacagttggaggtgtctttaaccacgcggtgccctccgcctctgctcatccgtttggagcccgtgtcggccgcggggctgcatgtggcagcgccacactgggcccgagcccgctgcaggcggcggccagcgcctcggcctcttcctttcaggccccggcctcggttgagacccggccgccccctccgcctccgcctccgcctcccccgctgcccccgcctgcgcacctgggccggtcccccgcggggccgcccgtcctccacgccccccctccacctaacgccgccttgcctcctcccccaacgctgctggcctctaaccctgagcccgcgcttctgcagagcctcgcgtccctcccgcctaaccaagctttcttgccccccacctctgctgcctctctgccgcctgctaacgcctctttgtctatcaagctcacctccctcccgcacaagggcgcccgcccctccttcacggtgcaccaccagcccctgccccggctggccctggcccaggccgcgcccgggatcccacaggccagcgccacggggccgtccgcggtgtgggtgtccctcggcatgccgcctccctatgccgcgcacctttcgggggttaagccgcgataaagaccttgcttagctagcagtgcgtattgtgtaaggtaactaggatttctacctcaaccgcgagacctatgcaaggacggtgtggaccaactcgcgcccgcggcatggtgcccgccggcctgccgggctcccacccctggacggcagaggcaaggacggacgggagctccactgtgaatcggcggcacgcgccgcaggaggctgggactggtccagtttgtactgtcgatagttttagataaagtatttatcattttttaaaaagtataaacaattctgacttattttattccatctaagtggtaaaaggcaacttattgagaaatataaatatctatatatgagagctctatataaagacacgtgtctgcagggcgggcccgccagcggattcgccacagcctgccccggtgctatctcgtccccaggcccgcgcctgcctccacccgcttggtgctgactagacgctgacaacgccgaaccccgttctcggaaacgccgcccggccggctcccccgacgcgctgctcccgtaccaaaggcaggcccgtcgccaccacattcctcggaggcctccccgcggcctgagccccttcctgagcgccctggcgcctgccctgagctcttcacctttaccccggcactgtgaacccccagactgttcaccctccggggcgtgggttgcgcccttgcatgtgaaggggcctgcgcggtgacgcagctggccatgtgctgcgcgatggtgctgtgaggacggcgcgggcacgttgaacaagtgcatttacttttgtatttctcggctgtccatggctcgcagcatgccctgcgatgcggggcaggcctgtcgtgggtcccttggtgtttctgtacaggagagagtcacactaatgagtggcagtattttatagagatgtgatgagaatttataaatttcatagatttgacagcttttatttttagatggtataatgcacagtgaagaggaaagaaaagcgaggggaaaaaaccttatttattcaaacagtgcacaaaatggccccagcgtcagccccgaccctagacccctcagttgcagctcccagcagcccagacagagctgccggcgcccctgcctgccccacatcccttcctgtcagggccacgcctggcacccatcccttggagcctgtgctggttctcccagctgctgtgggtgtgctggggccagggtgcactgctgaaacctggcctctctggccctaggccccagggtgacgtcggccccccactctgcagccttggcgggtgcctgggactgggtgtggaaggagaggagctgaggccggggtgtagcaggcaggcagggccactccagtgcttctggagccctgagcagtcagggcctgggttgtctgagcagtggtggctctgtgccctccctggaggatgggatctgggagtctgagctccccgcatctggccctgggctgtgtggcacttgctgagcccaccttctcaagtgcttgctcctgtgagatggcatcggggagccccttccccaaggtgccacagatccaccctccagggagctgccagccctgtgttctggttcccaagggcaggatggacacacgtcacatccctaccacgtggcctccaaagggagccacggaggaaaggcttctgtggttgctaggtgggggagtcctgtgtgggagggcctgaagacccctgcttgtgcctggtgaggggggtgctgcctcccccagcccccaacaacctctcagacccccaccctccaacatagctgagttctgaagatggtgctccggacctgtcctcttaagtggtgcccagtgccctccccaccccacgttggtgctctcagctagaaggtgctgtgcctctgcctgagccccaagccccgagcctggccttcaggacaggcagcctgctctgtgtcgccacgggccggatacgccacagggttgatggcagagacggccgagtccctggtctagaacaagacacattctttaaacactgtattacttctgcctccctctaggtgacagtggcagtccgggtgccatcacgggtcctgcagatggccatgcagggctcctgcccacgcaggccaccgtatgttcaggacacgcactgggtctcagagccactggcccaggcagaagtctccttgagcccactgggtcatatgcgtgtcaccacacgtgaactagtgtggtggctgcctgcggacaccctcctgttctgagccctgggcctgtgttcttctcagacactcccagactgaggggtggtgtgtggcgggtggcagggtggctgtggagactggggatctggagcctggtgctggcacctggcctgagtttccgtgggcagctggcggggacctgtgctgctgctgctgactgtgggtgggcgggcggcgcctgggagtggctcttgctcaggaattgataggaaccctaaaaactaggataccccctcctcggcccatgaggcacgcacagtgacttatttaagacttcccccttaatttatctgcccccaggatgcgtcagtctgttcagtggtcagcaggccccccaccccccgccgactgccctcgccatcgtggtcagacccccctcccaacacaacacgctgctggtctgtgtcagcctttgtaacgtgggaggctctgccgtgtcttccgggtgaactgtatttggattgcgcgcattgtcacggtccgcccctgggctgcaggcgccccttcctctgggcacccctgcattctgcatccccacctctagacgctgtaataaacagactgttttcactcggaaaaaaaat

SEQ ID NO: 369425 - DNA, 6730 bp, Homo sapiens
gcggccgcgcgcgcggacatgggggagaagctggagctgagactgaagtcgcccgtgggggctgagcccgccgtctacccgtggccgctgccggtctacgataaacatcacgatgctgctcatgaaatcatcgagaccatccgatgggtctgtgaagaaatcccggatctcaagctcgctatggagaattacgttttaattgactatgacaccaaaagcttcgagagcatgcagaggctctgcgacaagtacaaccgtgccatcgacagcatccaccagctgcaggtctacaaccactcggtgaccgaccccgagaagctcaacaactacgagcccttctcccccgaggtgtacggggagacctccttcgacctggtggcccagatgattgatgagatcaagatgaccgacgacgacctgtttgtggacttggggagcggtgtgggccaggtcgtgctccaggttgctgctgccaccaactgcaaacatcactatggcgtcgagaaagcagacatcccggccaagtatgcggagaccatggaccgcgagttcaggaagtggatgaaatggtatggaaaaaagcatgcagaatacacattggagagaggcgatttcctctcagaagagtggagggagcgaatcgccaacacgagtgttatatttgtgaataattttgcctttggtcctgaggtggatcaccagctgaaggagcggtttgcaaacatgaaggaaggtggcagaatcgtgtcctcgaaaccctttgcacctctgaacttcagaataaacagtagaaacttgagtgacatcggcaccatcatgcgcgtggtggagctctcgcccctgaagggctcggtgtcgtggacggggaagccagtctcctactacctgcacactatcgaccgcaccatacttgaaaactatttttctagtctgaaaaacccaaaactcagggaggaacaggaggcagcccggcgccgccagcagcgcgagagcaagagcaacgcggcacgcccactaagggcccagagggcaaggtggccggccccgccgacgcccccatggactctggtgctgaggaagagaaggcgggagcagccaccgtgaagaagccgtctccctccaaagcccgcaagaagaagctaaacaagaaggggaggaagatggctggccgcaagcgcgggcgccccaagaagatgaacactgcgaaccccgagcggaagcccaagaagaaccaaagtgcagcggcactcccccaacccgctgctggtggcgcccaccccgcccgcgctgcagaagcttctagagtccttcaagatccagtacctgcagttcctggcatacacaaagaccccccagtacaaggccagcctgcaggagctgctgggccaggagaaggagaagaacgcccagctcctgggtgcggctcagcagctcctcagccactgccaggcccagaaggaggagatcaggaggctgtttcagcaaaaattggatgagctgggtgtgaaggcgctgacctacaacgacctgattcaagcgcagaaggagatctccgcccataaccagcagctgcgggagcagtcggagcagctggagcaggacaaccgcgcgctccgcggccagagcttgcagctgctcaaggctcgctgcgaggagctgcagctggactgggccacgctgtcgctggagaagctgttgaaggagaagcaggccctgaagagccagatctcggagaagcagaggcactgcctggagctgcagatcagcattgtggagctagagaagagccagcggcagcaggagctcctgcagctcaagtcctgtgtgccgcctgacgacgccctgtccctgcacctgcgtgggaagggcgccctgggccgcgagctggagcctgacgccagccggctgcacctggagctggactgcaccaagttctcgctgcctcacttgagcagcatgagcccggagctctccatgaacggccaggctgctggctatgagctctgcggtgtgctgagccggccttcgtcgaagcagaacacgccccagtacctggcctcacccctggaccaggaggtggtgccctgtacccctagccacgtcggccggccgcgcctggagaagctgtctggcctagccgcacccgactacactaggctgtccccggccaagattgtgctgaggcggcacctgagccaggaccacacggtgcccggcaggccggctgccagtgagctgcattcgagagctgagcacaccaaggagaacggccttccctaccagagccccagcgtgcctggcagcatgaagctgagccctcaggacccgcggcccctgtcccctggggccttgcagcttgctggagagaagagcagtgagaagggcctgagagagcgcgcctacggcagcagcggggagctcatcaccagcctgcccatcagcatcccgctcagcaccgtgcagcccaacaagctcccggtcagcattcccctggccagcgtggtgctgcccagccgcgccgagagggcgaggagcacccccagtcccgtgctgcagccccgtgacccctcgtccacacttgaaaagcagattggtgctaatgcccacggtgctgggagcagaagccttgccctggcccccgcaggcttctcctacgctggctcggtggccatcagcggggccttggcgggcagcccggcctctctcacacctggagccgagccggccaccttggatgagtcctccagctctgggagcctttttgccaccgtggggtcccgcagctccacgccacagcaccccctgctgctggcacagccccggaactcgcttcctgcctctcccgcccaccagctctcctccagtccccggcttggtggggccgcccagggcccgttgcccgaggccagcaagggagacctgccctccgattccggcttctcagatcctgagagtgaagccaagaggaggattgtgttcaccatcaccactggtgcgggcagtgccaagcagtcgccctccagcaagcacagccccctgaccgccagcgcccgtggggactgtgtgccgagccacgggcaggacagtcgcaggcgcggccggcggaagcgagcatctgcggggacgcccagcttgagcgcaggcgtgtcccccaagcgccgagccctgccgtccgtcgctggccttttcacacagccttcggggtctcccctcaacctcaactccatggtcagtaacatcaaccagcccctggagattacagccatctcgtccccggagacctccctgaagagctcccctgtgccctaccaggaccacgaccagccccccgtgctcaagaaggagcggcctctgagccagaccaatggggcacactactccccactcacctcagacgaggagccaggctctgaggacgagcccagcagtgctcgaattgagagaaaaattgcaacaatctccttagaaagcaaatctcccccgaaaaccttggaaaatggtggtggcttggcgggaaggaagcccgcgcccgccggcgagccagtcaatagcagcaagtggaagtccaccttctcgcccatctccgacatcggcctggccaagtcggcggacagcccgctgcaggccagctccgccctcagccagaactccctgttcacgttccggcccgccctggaggagccctctgccgatgccaagctggccgctcaccccaggaaaggctttcccggctccctgtcgggggctgacggactcagcccgggcaccaaccctgccaacggctgcaccttcggcgggggcctggccgcggacctgagtttacacagcttcagtgatggtgcttctcttccccacaagggccccgaggcggccggcctgagctccccgctgagcttcccctcgcagcgcggcaaggagggctcggacgccaaccctttcctgagcaagaggcagctggacggcctggctgggctgaagggcgagggcagccgcggcaaggaggcaggggagggcggcctaccgctgtgcgggcccacggacaagaccccactgctgagcggcaaggccgccaaggcccgggaccgcgaggtcgacctcaagaatggccacaacctcttcatctctgcggcggccgtgcctcccggaagcctcctcagcggccccggcctggccccggcggcgtcctccgcaggcggcgcggcgtcctccgcccagacgcaccggtccttcctgggccccttcccgccgggaccgcagttcgcgctcggccccatgtccctgcaggccaacctcggctccgtggccggctcctccgtgctgcagtcgctgttcagctctgtgccggccgccgcaggcctggtgcacgtgtcgtccgctgccaccagactgaccaactcgcacgccatgggcagcttttccggggtggcaggcggcacagttggaggtgtctttaaccacgcggtgccctccgcctctgctcatccgtttggagcccgtgtcggccgcggggctgcatgtggcagcgccacactgggcccgagcccgctgcaggcggcggccagcgcctcggcctcttcctttcaggccccggcctcggttgagacccggccgccccctccgcctccgcctccgcctcccccgctgcccccgcctgcgcacctgggccggtcccccgcggggccgcccgtcctccacgccccccctccacctaacgccgccttgcctcctcccccaacgctgctggcctctaaccctgagcccgcgcttctgcagagcctcgcgtccctcccgcctaaccaagctttcttgccccccacctctgctgcctctctgccgcctgctaacgcctctttgtctatcaagctcacctccctcccgcacaagggcgcccgcccctccttcacggtgcaccaccagcccctgccccggctggccctggcccaggccgcgcccgggatcccacaggccagcgccacggggccgtccgcggtgtgggtgtccctcggcatgccgcctccctatgccgcgcacctttcgggggttaagccgcgataaagaccttgcttagctagcagtgcgtattgtgtaaggtaaggccagagccctgcgcggtggctcactccagacactgaactgtccttcctttggcagagaagacggccacagggctcggcagaagttccgggggtcctgaggagggaagagggagagagccagggagaccagggagatggtcgcgagaggagggactacaggacgggcaccagccatggagtggcctgagtgtgttgggttccagctgcccgcagctgggttcctgcggtgacgccgcaggactgaggccagccctgggggcagctgtgccagcccctgtgggcgaggctcacggggtgccaggccagggggctgggagctctagctcctagagcagtctccagggctccatccgcaccaggcccaggtcactcatgacgggtggcgtggcttggtgctgttccccaggcgcccagcatgtagcaggcacggtgccggctgcagaggtcctggagagccagggtggctggctggatgcctctggtcggggctgtctggccagtagcctcggatgccctcatagggagccagtgaagccccaagtgccctgcctgcctgggggctgatgggttcccggcggggtcgagaggcaagctctgtgccctgcgtgttgaggcccccttgctggacacggctgatggccacactgccctgtggtcatggcccacagccgaggggctttcagctgctcagatgtcagcaccaagctgggcaggttagtgtagacggtgcccacctttgagaccagaaggaagttggaagcaggagtgattttgatgatgtgaggccttcagggaatgtcctgttcactcctcccccaagaggctgtggagactgtggccgctgacccctgagggcagttggccacccgtgccctccagggacatggcgtgcctggcggcgtagtgcaaaggtgccctctgcttgcccctggccttctgcctcaggggcccctgggacacaggccttcctgggcgagtccaaagcccaccgggcaaggagaggaggactgggagccaggagccaaggcggaggctgtggccagggctggtcagcctggcgggtcaatgcgggcacctgcgggctggacaagctatgctgggtctcttaggagatgagctgcaggtagggtggctttagctggactcggctgtgtgtctcctttggaggaaggctggagcttggccggcgtgtccaggtgtcaggctccctggtctgtcacggggcacgcccgtcgtctgttgtggttagaggagctggcactatgcctgtcatggtgctggccccaggtggcgtgtgtgctcgtgggaggcctcggtccccagcctgggtgagtgttgggctcccccaggcgcgatggtaacctcaggccgctcttcccgctgtgcccttctgcaggtaactaggatttctacctcaaccgcgagacctatgcaaggacggtgtggaccaactcgcgcccgcggcatggtgcccgccggcctgccgggctcccacccctggacggcagaggcaaggacggacgggagctccactgtgaatcggcggcacgcgccgcaggaggctgggactggtccagtttgtactgtcgatagttttagataaagtatttatcattttttaaaaagtataaaca

SEQ ID NO: 369426 - DNA, 6046 bp, Homo sapiens
gcggccgcgcgcgcggacatgggggagaagctggagctgagactgaagtcgcccgtgggggctgagcccgccgtctacccgtggccgctgccggtctacgataaacatcacgatgctgctcatgaaatcatcgagaccatccgatgggtctgtgaagaaatcccggatctcaagctcgctatggagaattacgttttaattgactatgacaccaaaagcttcgagagcatgcagaggctctgcgacaagtacaaccgtgccatcgacagcatccaccagctgtggaagggcaccacgcagcccatgaagctgaacacgcggccgtccactggactcctgcgccatatcctgcagcaggtctacaaccactcggtgaccgaccccgagaagctcaacaactacgagcccttctcccccgaggtgtacggggagacctccttcgacctggtggcccagatgattgatgagatcaagatgaccgacgacgacctgtttgtggacttggggagcggtgtgggccaggtcgtgctccaggttgctgctgccaccaactgcaaacatcactatggcgtcgagaaagcagacatcccggccaagtatgcggagaccatggaccgcgagttcaggaagtggatgaaatggtatggaaaaaagcatgcagaatacacattggagagaggcgatttcctctcagaagagtggagggagcgaatcgccaacacgagtgttatatttgtgaataattttgcctttggtcctgaggtggatcaccagctgaaggagcggtttgcaaacatgaaggaaggtggcagaatcgtgtcctcgaaaccctttgcacctctgaacttcagaataaacagtagaaacttgagtgacatcggcaccatcatgcgcgtggtggagctctcgcccctgaagggctcggtgtcgtggacggggaagccagtctcctactacctgcacactatcgaccgcaccatacttgaaaactatttttctagtctgaaaaacccaaaactcagggaggaacaggaggcagcccggcgccgccagcagcgcgagagcaagagcaacgcggcacgcccactaagggcccagagggcaaggtggccggccccgccgacgcccccatggactctggtgctgaggaagagaaggcgggagcagccaccgtgaagaagccgtctccctccaaagcccgcaagaagaagctaaacaagaaggggaggaagatggctggccgcaagcgcgggcgccccaagaagatgaacactgcgaaccccgagcggaagcccaagaagaaccaaagtgcagcggcactcccccaacccgctgctggtggcgcccaccccgcccgcgctgcagaagcttctagagtccttcaagatccagtacctgcagttcctggcatacacaaagaccccccagtacaaggccagcctgcaggagctgctgggccaggagaaggagaagaacgcccagctcctgggtgcggctcagcagctcctcagccactgccaggcccagaaggaggagatcaggaggctgtttcagcaaaaattggatgagctgggtgtgaaggcgctgacctacaacgacctgattcaagcgcagaaggagatctccgcccataaccagcagctgcgggagcagtcggagcagctggagcaggacaaccgcgcgctccgcggccagagcttgcagctgctcaaggctcgctgcgaggagctgcagctggactgggccacgctgtcgctggagaagctgttgaaggagaagcaggccctgaagagccagatctcggagaagcagaggcactgcctggagctgcagatcagcattgtggagctagagaagagccagcggcagcaggagctcctgcagctcaagtcctgtgtgccgcctgacgacgccctgtccctgcacctgcgtgggaagggcgccctgggccgcgagctggagcctgacgccagccggctgcacctggagctggactgcaccaagttctcgctgcctcacttgagcagcatgagcccggagctctccatgaacggccaggctgctggctatgagctctgcggtgtgctgagccggccttcgtcgaagcagaacacgccccagtacctggcctcacccctggaccaggaggtggtgccctgtacccctagccacgtcggccggccgcgcctggagaagctgtctggcctagccgcacccgactacactaggctgtccccggccaagattgtgctgaggcggcacctgagccaggaccacacggtgcccggcaggccggctgccagtgagctgcattcgagagctgagcacaccaaggagaacggccttccctaccagagccccagcgtgcctggcagcatgaagctgagccctcaggacccgcggcccctgtcccctggggccttgcagcttgctggagagaagagcagtgagaagggcctgagagagcgcgcctacggcagcagcggggagctcatcaccagcctgcccatcagcatcccgctcagcaccgtgcagcccaacaagctcccggtcagcattcccctggccagcgtggtgctgcccagccgcgccgagagggcgaggagcacccccagtcccgtgctgcagccccgtgacccctcgtccacacttgaaaagcagattggtgctaatgcccacggtgctgggagcagaagccttgccctggcccccgcaggcttctcctacgctggctcggtggccatcagcggggccttggcgggcagcccggcctctctcacacctggagccgagccggccaccttggatgagtcctccagctctgggagcctttttgccaccgtggggtcccgcagctccacgccacagcaccccctgctgctggcacagccccggaactcgcttcctgcctctcccgcccaccagctctcctccagtccccggcttggtggggccgcccagggcccgttgcccgaggccagcaagggagacctgccctccgattccggcttctcagatcctgagagtgaagccaagaggaggattgtgttcaccatcaccactggtgcgggcagtgccaagcagtcgccctccagcaagcacagccccctgaccgccagcgcccgtggggactgtgtgccgagccacgggcaggacagtcgcaggcgcggccggcggaagcgagcatctgcggggacgcccagcttgagcgcaggcgtgtcccccgtgctcaagaaggagcggcctctgagccagaccaatggggcacactactccccactcaactccatggtcagtaacatcaaccagcccctggagattacagccatctcgtccccggagacctccctgaagagctcccctgtgccctaccaggaccactgtgaatcggcggcacgcgccgcaggaggctgggactggtccagtttgtactgtcgatagttttagataaagtatttatcattttttaaaaagtataaacaattctgacttattttattccatctaagtggtaaaaggcaacttattgagaaatataaatatctatatatgagagctctatataaagacacgtgtctgcagggcgggcccgccagcggattcgccacagcctgccccggtgctatctcgtccccaggcccgcgcctgcctccacccgcttggtgctgactagacgctgacaacgccgaaccccgttctcggaaacgccgcccggccggctcccccgacgcgctgctcccgtaccaaaggcaggcccgtcgccaccacattcctcggaggcctccccgcggcctgagccccttcctgagcgccctggcgcctgccctgagctcttcacctttaccccggcactgtgaacccccagactgttcaccctccggggcgtgggttgcgcccttgcatgtgaaggggcctgcgcggtgacgcagctggccatgtgctgcgcgatggtgctgtgaggacggcgcgggcacgttgaacaagtgcatttacttttgtatttctcggctgtccatggctcgcagcatgccctgcgatgcggggcaggcctgtcgtgggtcccttggtgtttctgtacaggagagagtcacactaatgagtggcagtattttatagagatgtgatgagaatttataaatttcatagatttgacagcttttatttttagatggtataatgcacagtgaagaggaaagaaaagcgaggggaaaaaaccttatttattcaaacagtgcacaaaatggccccagcgtcagccccgaccctagacccctcagttgcagctcccagcagcccagacagagctgccggcgcccctgcctgccccacatcccttcctgtcagggccacgcctggcacccatcccttggagcctgtgctggttctcccagctgctgtgggtgtgctggggccagggtgcactgctgaaacctggcctctctggccctaggccccagggtgacgtcggccccccactctgcagccttggcgggtgcctgggactgggtgtggaaggagaggagctgaggccggggtgtagcaggcaggcagggccactccagtgcttctggagccctgagcagtcagggcctgggttgtctgagcagtggtggctctgtgccctccctggaggatgggatctgggagtctgagctccccgcatctggccctgggctgtgtggcacttgctgagcccaccttctcaagtgcttgctcctgtgagatggcatcggggagccccttccccaaggtgccacagatccaccctccagggagctgccagccctgtgttctggttcccaagggcaggatggacacacgtcacatccctaccacgtggcctccaaagggagccacggaggaaaggcttctgtggttgctaggtgggggagtcctgtgtgggagggcctgaagacccctgcttgtgcctggtgaggggggtgctgcctcccccagcccccaacaacctctcagacccccaccctccaacatagctgagttctgaagatggtgctccggacctgtcctcttaagtggtgcccagtgccctccccaccccacgttggtgctctcagctagaaggtgctgtgcctctgcctgagccccaagccccgagcctggccttcaggacaggcagcctgctctgtgtcgccacgggccggatacgccacagggttgatggcagagacggccgagtccctggtctagaacaagacacattctttaaacactgtattacttctgcctccctctaggtgacagtggcagtccgggtgccatcacgggtcctgcagatggccatgcagggctcctgcccacgcaggccaccgtatgttcaggacacgcactgggtctcagagccactggcccaggcagaagtctccttgagcccactgggtcatatgcgtgtcaccacacgtgaactagtgtggtggctgcctgcggacaccctcctgttctgagccctgggcctgtgttcttctcagacactcccagactgaggggtggtgtgtggcgggtggcagggtggctgtggagactggggatctggagcctggtgctggcacctggcctgagtttccgtgggcagctggcggggacctgtgctgctgctgctgactgtgggtgggcgggcggcgcctgggagtggctcttgctcaggaattgataggaaccctaaaaactaggataccccctcctcggcccatgaggcacgcacagtgacttatttaagacttcccccttaatttatctgcccccaggatgcgtcagtctgttcagtggtcagcaggccccccaccccccgccgactgccctcgccatcgtggtcagacccccctcccaacacaacacgctgctggtctgtgtcagcctttgtaacgtgggaggctctgccgtgtcttccgggtgaactgtatttggattgcgcgcattgtcacggtccgcccctgggctgcaggcgccccttcctctgggcacccctgcattctgcatccccacctctagacgctgtaataaacagactgttttcactcggaaaaaaaat

SEQ ID NO: 369427 - DNA, 5051 bp, Homo sapiens
attagtgcctctgcgtcgacgaaggccggctgccagtgagctgcattcgagagctgagcacaccaaggagaacggccttccctaccagagccccagcgtgcctggcagcatgaagctgagccctcaggacccgcggcccctgtcccctggggccttgcagcttgctggagagaagagcagtgagaagggcctgagagagcgcgcctacggcagcagcggggagctcatcaccagcctgcccatcagcatcccgctcagcaccgtgcagcccaacaagctcccggtcagcattcccctggccagcgtggtgctgcccagccgcgccgagagggcgaggagcacccccagtcccgtgctgcagccccgtgacccctcgtccacacttgaaaagcagattggtgctaatgcccacggtgctgggagcagaagccttgccctggcccccgcaggcttctcctacgctggctcggtggccatcagcggggccttggcgggcagcccggcctctctcacacctggagccgagccggccaccttggatgagtcctccagctctgggagcctttttgccaccgtggggtcccgcagctccacgccacagcaccccctgctgctggcacagccccggaactcgcttcctgcctctcccgcccaccagctctcctccagtccccggcttggtggggccgcccagggcccgttgcccgaggccagcaagggagacctgccctccgattccggcttctcagatcctgagagtgaagccaagaggaggattgtgttcaccatcaccactggtgcgggcagtgccaagcagtcgccctccagcaagcacagccccctgaccgccagcgcccgtggggactgtgtgccgagccacgggcaggacagtcgcaggcgcggccggcggaagcgagcatctgcggggacgcccagcttgagcgcaggcgtgtcccccaagcgccgagccctgccgtccgtcgctggccttttcacacagccttcggggtctcccctcaacctcaactccatggtcagtaacatcaaccagcccctggagattacagccatctcgtccccggagacctccctgaagagctcccctgtgccctaccaggaccacgaccagccccccgtgctcaagaaggagcggcctctgagccagaccaatggggcacactactccccactcacctcagacgaggagccaggctctgaggacgagcccagcagtgctcgaattgagagaaaaattgcaacaatctccttagaaagcaaatctcccccgaaaaccttggaaaatggtggtggcttggcgggaaggaagcccgcgcccgccggcgagccagtcaatagcagcaagtggaagtccaccttctcgcccatctccgacatcggcctggccaagtcggcggacagcccgctgcaggccagctccgccctcagccagaactccctgttcacgttccggcccgccctggaggagccctctgccgatgccaagctggccgctcaccccaggaaaggctttcccggctccctgtcgggggctgacggactcagcccgggcaccaaccctgccaacggctgcaccttcggcgggggcctggccgcggacctgagtttacacagcttcagtgatggtgcttctcttccccacaagggccccgaggcggccggcctgagctccccgctgagcttcccctcgcagcgcggcaaggagggctcggacgccaaccctttcctgagcaagaggcagctggacggcctggctgggctgaagggcgagggcagccgcggcaaggaggcaggggagggcggcctaccgctgtgcgggcccacggacaagaccccactgctgagcggcaaggccgccaaggcccgggaccgcgaggtcgacctcaagaatggccacaacctcttcatctctgcggcggccgtgcctcccggaagcctcctcagcggccccggcctggccccggcggcgtcctccgcaggcggcgcggcgtcctccgcccagacgcaccggtccttcctgggccccttcccgccgggaccgcagttcgcgctcggccccatgtccctgcaggccaacctcggctccgtggccggctcctccgtgctgcagtcgctgttcagctctgtgccggccgccgcaggcctggtgcacgtgtcgtccgctgccaccagactgaccaactcgcacgccatgggcagcttttccggggtggcaggcggcacagttggaggtaactaggatttctacctcaaccgcgagacctatgcaaggacggtgtggaccaactcgcgcccgcggcatggtgcccgccggcctgccgggctcccacccctggacggcagaggcaaggacggacgggagctccactgtgaatcggcggcacgcgccgcaggaggctgggactggtccagtttgtactgtcgatagttttagataaagtatttatcattttttaaaaagtataaacaattctgacttattttattccatctaagtggtaaaaggcaacttattgagaaatataaatatctatatatgagagctctatataaagacacgtgtctgcagggcgggcccgccagcggattcgccacagcctgccccggtgctatctcgtccccaggcccgcgcctgcctccacccgcttggtgctgactagacgctgacaacgccgaaccccgttctcggaaacgccgcccggccggctcccccgacgcgctgctcccgtaccaaaggcaggcccgtcgccaccacattcctcggaggcctccccgcggcctgagccccttcctgagcgccctggcgcctgccctgagctcttcacctttaccccggcactgtgaacccccagactgttcaccctccggggcgtgggttgcgcccttgcatgtgaaggggcctgcgcggtgacgcagctggccatgtgctgcgcgatggtgctgtgaggacggcgcgggcacgttgaacaagtgcatttacttttgtatttctcggctgtccatggctcgcagcatgccctgcgatgcggggcaggcctgtcgtgggtcccttggtgtttctgtacaggagagagtcacactaatgagtggcagtattttatagagatgtgatgagaatttataaatttcatagatttgacagcttttatttttagatggtataatgcacagtgaagaggaaagaaaagcgaggggaaaaaaccttatttattcaaacagtgcacaaaatggccccagcgtcagccccgaccctagacccctcagttgcagctcccagcagcccagacagagctgccggcgcccctgcctgccccacatcccttcctgtcagggccacgcctggcacccatcccttggagcctgtgctggttctcccagctgctgtgggtgtgctggggccagggtgcactgctgaaacctggcctctctggccctaggccccagggtgacgtcggccccccactctgcagccttggcgggtgcctgggactgggtgtggaaggagaggagctgaggccggggtgtagcaggcaggcagggccactccagtgcttctggagccctgagcagtcagggcctgggttgtctgagcagtggtggctctgtgccctccctggaggatgggatctgggagtctgagctccccgcatctggccctgggctgtgtggcacttgctgagcccaccttctcaagtgcttgctcctgtgagatggcatcggggagccccttccccaaggtgccacagatccaccctccagggagctgccagccctgtgttctggttcccaagggcaggatggacacacgtcacatccctaccacgtggcctccaaagggagccacggaggaaaggcttctgtggttgctaggtgggggagtcctgtgtgggagggcctgaagacccctgcttgtgcctggtgaggggggtgctgcctcccccagcccccaacaacctctcagacccccaccctccaacatagctgagttctgaagatggtgctccggacctgtcctcttaagtggtgcccagtgccctccccaccccacgttggtgctctcagctagaaggtgctgtgcctctgcctgagccccaagccccgagcctggccttcaggacaggcagcctgctctgtgtcgccacgggccggatacgccacagggttgatggcagagacggccgagtccctggtctagaacaagacacattctttaaacactgtattacttctgcctccctctaggtgacagtggcagtccgggtgccatcacgggtcctgcagatggccatgcagggctcctgcccacgcaggccaccgtatgttcaggacacgcactgggtctcagagccactggcccaggcagaagtctccttgagcccactgggtcatatgcgtgtcaccacacgtgaactagtgtggtggctgcctgcggacaccctcctgttctgagccctgggcctgtgttcttctcagacactcccagactgaggggtggtgtgtggcgggtggcagggtggctgtggagactggggatctggagcctggtgctggcacctggcctgagtttccgtgggcagctggcggggacctgtgctgctgctgctgactgtgggtgggcgggcggcgcctgggagtggctcttgctcaggaattgataggaaccctaaaaactaggataccccctcctcggcccatgaggcacgcacagtgacttatttaagacttcccccttaatttatctgcccccaggatgcgtcagtctgttcagtggtcagcaggccccccaccccccgccgactgccctcgccatcgtggtcagacccccctcccaacacaacacgctgctggtctgtgtcagcctttgtaacgtgggaggctctgccgtgtcttccgggtgaactgtatttggattgcgcgcattgtcacggtccgcccctgggctgcaggcgccccttcctctgggcacccctgcattctgcatccccacctctagacgctgtaataaacagactgttttcactcggaaaaaaaat

SEQ ID NO: 369428 - DNA, 4255 bp, Homo sapiens
ttcccacaaacacaacacacaccaccacacacccccacaccacacacacccaacaccaccccaacccaacggctaggagcgaggctgggtgtcggtcgcaggcgcggccggcggaagcgagcatctgcggggacgcccagcttgagcgcaggcgtgtcccccaagcgccgagccctgccgtccgtcgctggccttttcacacagccttcggggtctcccctcaacctcaactccatggtcagtaacatcaaccagcccctggagattacagccatctcgtccccggagacctccctgaagagctcccctgtgccctaccaggaccacgaccagccccccgtgctcaagaaggagcggcctctgagccagaccaatggggcacactactccccactcacctcagacgaggagccaggctctgaggacgagcccagcagtgctcgaattgagagaaaaattgcaacaatctccttagaaagcaaatctcccccgaaaaccttggaaaatggtggtggcttggcgggaaggaagcccgcgcccgccggcgagccagtcaatagcagcaagtggaagtccaccttctcgcccatctccgacatcggcctggccaagtcggcggacagcccgctgcaggccagctccgccctcagccagaactccctgttcacgttccggcccgccctggaggagccctctgccgatgccaagctggccgctcaccccaggaaaggctttcccggctccctgtcgggggctgacggactcagcccgggcaccaaccctgccaacggctgcaccttcggcgggggcctggccgcggacctgagtttacacagcttcagtgatggtgcttctcttccccacaagggccccgaggcggccggcctgagctccccgctgagcttcccctcgcagcgcggcaaggagggctcggacgccaaccctttcctgagcaagaggcagctggacggcctggctgggctgaagggcgagggcagccgcggcaaggaggcaggggagggcggcctaccgctgtgcgggcccacggacaagaccccactgctgagcggcaaggccgccaaggcccgggaccgcgaggtcgacctcaagaatggccacaacctcttcatctctgcggcggccgtgcctcccggaagcctcctcagcggccccggcctggccccggcggcgtcctccgcaggcggcgcggcgtcctccgcccagacgcaccggtccttcctgggccccttcccgccgggaccgcagttcgcgctcggccccatgtccctgcaggccaacctcggctccgtggccggctcctccgtgctgcagtcgctgttcagctctgtgccggccgccgcaggcctggtgcacgtgtcgtccgctgccaccagactgaccaactcgcacgccatgggcagcttttccggggtggcaggcggcacagttggaggtaactaggatttctacctcaaccgcgagacctatgcaaggacggtgtggaccaactcgcgcccgcggcatggtgcccgccggcctgccgggctcccacccctggacggcagaggcaaggacggacgggagctccactgtgaatcggcggcacgcgccgcaggaggctgggactggtccagtttgtactgtcgatagttttagataaagtatttatcattttttaaaaagtataaacaattctgacttattttattccatctaagtggtaaaaggcaacttattgagaaatataaatatctatatatgagagctctatataaagacacgtgtctgcagggcgggcccgccagcggattcgccacagcctgccccggtgctatctcgtccccaggcccgcgcctgcctccacccgcttggtgctgactagacgctgacaacgccgaaccccgttctcggaaacgccgcccggccggctcccccgacgcgctgctcccgtaccaaaggcaggcccgtcgccaccacattcctcggaggcctccccgcggcctgagccccttcctgagcgccctggcgcctgccctgagctcttcacctttaccccggcactgtgaacccccagactgttcaccctccggggcgtgggttgcgcccttgcatgtgaaggggcctgcgcggtgacgcagctggccatgtgctgcgcgatggtgctgtgaggacggcgcgggcacgttgaacaagtgcatttacttttgtatttctcggctgtccatggctcgcagcatgccctgcgatgcggggcaggcctgtcgtgggtcccttggtgtttctgtacaggagagagtcacactaatgagtggcagtattttatagagatgtgatgagaatttataaatttcatagatttgacagcttttatttttagatggtataatgcacagtgaagaggaaagaaaagcgaggggaaaaaaccttatttattcaaacagtgcacaaaatggccccagcgtcagccccgaccctagacccctcagttgcagctcccagcagcccagacagagctgccggcgcccctgcctgccccacatcccttcctgtcagggccacgcctggcacccatcccttggagcctgtgctggttctcccagctgctgtgggtgtgctggggccagggtgcactgctgaaacctggcctctctggccctaggccccagggtgacgtcggccccccactctgcagccttggcgggtgcctgggactgggtgtggaaggagaggagctgaggccggggtgtagcaggcaggcagggccactccagtgcttctggagccctgagcagtcagggcctgggttgtctgagcagtggtggctctgtgccctccctggaggatgggatctgggagtctgagctccccgcatctggccctgggctgtgtggcacttgctgagcccaccttctcaagtgcttgctcctgtgagatggcatcggggagccccttccccaaggtgccacagatccaccctccagggagctgccagccctgtgttctggttcccaagggcaggatggacacacgtcacatccctaccacgtggcctccaaagggagccacggaggaaaggcttctgtggttgctaggtgggggagtcctgtgtgggagggcctgaagacccctgcttgtgcctggtgaggggggtgctgcctcccccagcccccaacaacctctcagacccccaccctccaacatagctgagttctgaagatggtgctccggacctgtcctcttaagtggtgcccagtgccctccccaccccacgttggtgctctcagctagaaggtgctgtgcctctgcctgagccccaagccccgagcctggccttcaggacaggcagcctgctctgtgtcgccacgggccggatacgccacagggttgatggcagagacggccgagtccctggtctagaacaagacacattctttaaacactgtattacttctgcctccctctaggtgacagtggcagtccgggtgccatcacgggtcctgcagatggccatgcagggctcctgcccacgcaggccaccgtatgttcaggacacgcactgggtctcagagccactggcccaggcagaagtctccttgagcccactgggtcatatgcgtgtcaccacacgtgaactagtgtggtggctgcctgcggacaccctcctgttctgagccctgggcctgtgttcttctcagacactcccagactgaggggtggtgtgtggcgggtggcagggtggctgtggagactggggatctggagcctggtgctggcacctggcctgagtttccgtgggcagctggcggggacctgtgctgctgctgctgactgtgggtgggcgggcggcgcctgggagtggctcttgctcaggaattgataggaaccctaaaaactaggataccccctcctcggcccatgaggcacgcacagtgacttatttaagacttcccccttaatttatctgcccccaggatgcgtcagtctgttcagtggtcagcaggccccccaccccccgccgactgccctcgccatcgtggtcagacccccctcccaacacaacacgctgctggtctgtgtcagcctttgtaacgtgggaggctctgccgtgtcttccgggtgaactgtatttggattgcgcgcattgtcacggtccgcccctgggctgcaggcgccccttcctctgggcacccctgcattctgcatccccacctctagacgctgtaataaacagactgttttcactcggaaaaaaaat

SEQ ID NO: 369429 - DNA, 5400 bp, Homo sapiens
gcggccgcgcgcgcggacatgggggagaagctggagctgagactgaagtcgcccgtgggggctgagcccgccgtctacccgtggccgctgccggtctacgataaacatcacgatgctgctcatgaaatcatcgagaccatccgatgggtctgtgaagaaatcccggatctcaagctcgctatggagaattacgttttaattgactatgacaccaaaagcttcgagagcatgcagaggctctgcgacaagtacaaccgtgccatcgacagcatccaccagctgtggaagggcaccacgcagcccatgaagctgaacacgcggccgtccactggactcctgcgccatatcctgcagcaggtctacaaccactcggtgaccgaccccgagaagctcaacaactacgagcccttctcccccgaggtgtacggggagacctccttcgacctggtggcccagatgattgatgagatcaagatgaccgacgacgacctgtttgtggacttggggagcggtgtgggccaggtcgtgctccaggttgctgctgccaccaactgcaaacatcactatggcgtcgagaaagcagacatcccggccaagtatgcggagaccatggaccgcgagttcaggaagtggatgaaatggtatggaaaaaagcatgcagaatacacattggagagaggcgatttcctctcagaagagtggagggagcgaatcgccaacacgagtgttatatttgtgaataattttgcctttggtcctgaggtggatcaccagctgaaggagcggtttgcaaacatgaaggaaggtggcagaatcgtgtcctcgaaaccctttgcacctctgaacttcagaataaacagtagaaacttgagtgacatcggcaccatcatgcgcgtggtggagctctcgcccctgaagggctcggtgtcgtggacggggaagccagtctcctactacctgcacactatcgaccgcaccatacttgaaaactatttttctagtctgaaaaacccaaaactcagggaggaacaggaggcagcccggcgccgccagcagcgcgagagcaagagcaacgcggcacgcccactaagggcccagagggcaaggtggccggccccgccgacgcccccatggactctggtgctgaggaagagaaggcgggagcagccaccgtgaagaagccgtctccctccaaagcccgcaagaagaagctaaacaagaaggggaggaagatggctggccgcaagcgcgggcgccccaagaagatgaacactgcgaaccccgagcggaagcccaagaagaaccaaagtgcagcggcactcccccaacccgctgctggtggcgcccaccccgcccgcgctgcagaagcttctagagtccttcaagatccagtacctgcagttcctggcatacacaaagaccccccagtacaaggccagcctgcaggagctgctgggccaggagaaggagaagaacgcccagctcctgggtgcggctcagcagctcctcagccactgccaggcccagaaggaggagatcaggaggctgtttcagcaaaaattggatgagctgggtgtgaaggcgctgacctacaacgacctgattcaagcgcagaaggagatctccgcccataaccagcagctgcgggagcagtcggagcagctggagcaggacaaccgcgcgctccgcggccagagcttgcagctgctcaaggctcgctgcgaggagctgcagctggactgggccacgctgtcgctggagaagctgttgaaggagaagcaggccctgaagagccagatctcggagaagcagaggcactgcctggagctgcagatcagcattgtggagctagagaagagccagcggcagcaggagctcctgcagctcaagtcctgtgtgccgcctgacgacgccctgtccctgcacctgcgtgggaagggcgccctgggccgcgagctggagcctgacgccagccggctgcacctggagctggactgcaccaagttctcgctgcctcacttgagcagcatgagcccggagctctccatgaacggccaggctgctggctatgagctctgcggtgtgctgagccggccttcgtcgaagcagaacacgccccagtacctggcctcacccctggaccaggaggtggtgccctgtacccctagccacgtcggccggccgcgcctggagaagctgtctggcctagccgcacccgactacactaggctgtccccggccaagattgtgctgaggcggcacctgagccaggaccacacggtgcccggcaggccggctgccagtgagctgcattcgagagctgagcacaccaaggagaacggccttccctaccagagccccagcgtgcctggcagcatgaagctgagccctcaggacccgcggcccctgtcccctggggccttgcagcttgctggagagaagagcagtgagaagggcctgagagagcgcgcctacggcagcagcggggagctcatcaccagcctgcccatcagcatcccgctcagcaccgtgcagcccaacaagctcccggtcagcattcccctggccagcgtggtgctgcccagccgcgccgagagggcgaggagcacccccagtcccgtgctgcagccccgtgacccctcgtccacacttgaaaagcagattggtgctaatgcccacggtgctgggagcagaagccttgccctggcccccgcaggcttctcctacgctggctcggtggccatcagcggggccttggcgggcagcccggcctctctcacacctggagccgagccggccaccttggatgagtcctccagctctgggagcctttttgccaccgtggggtcccgcagctccacgccacagcaccccctgctgctggcacagccccggaactcgcttcctgcctctcccgcccaccagctctcctccagtccccggcttggtggggccgcccagggcccgttgcccgaggccagcaagggagacctgccctccgattccggcttctcagatcctgagagtgaagccaagaggaggattgtgttcaccatcaccactggtgcgggcagtgccaagcagtcgccctccagcaagcacagccccctgaccgccagcgcccgtggggactgtgtgccgagccacgggcaggacagtcgcaggcgcggccggcggaagcgagcatctgcggggacgcccagcttgagcgcaggcgtgtcccccaagcgccgagccctgccgtccgtcgctggccttttcacacagccttcggggtctcccctcaacctcaactccatggtcagtaacatcaaccagcccctggagattacagccatctcgtccccggagacctccctgaagagctcccctgtgccctaccaggaccacgaccagccccccgtgctcaagaaggagcggcctctgagccagaccaatggggcacactactccccactcacctcagacgaggagccaggctctgaggacgagcccagcagtgctcgaattgagagaaaaattgcaacaatctccttagaaagcaaatctcccccgaaaaccttggaaaatggtggtggcttggcgggaaggaagcccgcgcccgccggcgagccagtcaatagcagcaagtggaagtccaccttctcgcccatctccgacatcggcctggccaagtcggcggacagcccgctgcaggccagctccgccctcagccagaactccctgttcacgttccggcccgccctggaggagccctctgccgatgccaagctggccgctcaccccaggaaaggctttcccggctccctgtcgggggctgacggactcagcccgggcaccaaccctgccaacggctgcaccttcggcgggggcctggccgcggacctgagtttacacagcttcagtgatggtgcttctcttccccacaagggccccgaggcggccggcctgagctccccgctgagcttcccctcgcagcgcggcaaggagggctcggacgccaaccctttcctgagcaagaggcagctggacggcctggctgggctgaagggcgagggcagccgcggcaaggaggcaggggagggcggcctaccgctgtgcgggcccacggacaagaccccactgctgagcggcaaggccgccaaggcccgggaccgcgaggtcgacctcaagaatggccacaacctcttcatctctgcggcggccgtgcctcccggaagcctcctcagcggccccggcctggccccggcggcgtcctccgcaggcggcgcggcgtcctccgcccagacgcaccggtccttcctgggccccttcccgccgggaccgcagttcgcgctcggccccatgtccctgcaggccaacctcggctccgtggccggctcctccgtgctgcagtcgctgttcagctctgtgccggccgccgcaggcctggtgcacgtgtcgtccgctgccaccagactgaccaactcgcacgccatgggcagcttttccggggtggcaggcggcacagttggaggtgtctttaaccacgcggtgccctccgcctctgctcatccgtttggagcccgtgtcggccgcggggctgcatgtggcagcgccacactgggcccgagcccgctgcaggcggcggccagcgcctcggcctcttcctttcaggccccggcctcggttgagacccggccgccccctccgcctccgcctccgcctcccccgctgcccccgcctgcgcacctgggccggtcccccgcggggccgcccgtcctccacgccccccctccacctaacgccgccttgcctcctcccccaacgctgctggcctctaaccctgagcccgcgcttctgcagagcctcgcgtccctcccgcctaaccaagctttcttgccccccacctctgctgcctctctgccgcctgctaacgcctctttgtctatcaagctcacctccctcccgcacaagggcgcccgcccctccttcacggtgcaccaccagcccctgccccggctggccctggcccaggccgcgcccgggatcccacaggccagcgccacggggccgtccgcggtgtgggtgtccctcggcatgccgcctccctatgccgcgcacctttcgggggttaagccgcgataaagaccttgcttagctagcagtgcgtattgtgtaaggtaactaggatttctacctcaaccgcgagacctatgcaaggacggtgtggaccaactcgcgcccgcggcatggtgcccgccggcctgccgggctcccacccctggacggcagaggcaaggacggacgggagctccactgtgaatcggcggcacgcgccgcaggaggctgggactggtccagtttgtactgtcgatagttttagataaagtatttatcattttttaaaaagtataaaca

SEQ ID NO: 369430 - DNA, 7497 bp, Homo sapiens
gcggccgcgcgcgcggacatgggggagaagctggagctgagactgaagtcgcccgtgggggctgagcccgccgtctacccgtggccgctgccggtctacgataaacatcacgatgctgctcatgaaatcatcgagaccatccgatgggtctgtgaagaaatcccggatctcaagctcgctatggagaattacgttttaattgactatgacaccaaaagcttcgagagcatgcagaggctctgcgacaagtacaaccgtgccatcgacagcatccaccagctgtggaagggcaccacgcagcccatgaagctgaacacgcggccgtccactggactcctgcgccatatcctgcagcaggtctacaaccactcggtgaccgaccccgagaagctcaacaactacgagcccttctcccccgaggtgtacggggagacctccttcgacctggtggcccagatgattgatgagatcaagatgaccgacgacgacctgtttgtggacttggggagcggtgtgggccaggtcgtgctccaggttgctgctgccaccaactgcaaacatcactatggcgtcgagaaagcagacatcccggccaagtatgcggagaccatggaccgcgagttcaggaagtggatgaaatggtatggaaaaaagcatgcagaatacacattggagagaggcgatttcctctcagaagagtggagggagcgaatcgccaacacgagtgttatatttgtgaataattttgcctttggtcctgaggtggatcaccagctgaaggagcggtttgcaaacatgaaggaaggtggcagaatcgtgtcctcgaaaccctttgcacctctgaacttcagaataaacagtagaaacttgagtgacatcggcaccatcatgcgcgtggtggagctctcgcccctgaagggctcggtgtcgtggacggggaagccagtctcctactacctgcacactatcgaccgcaccatacttgaaaactatttttctagtctgaaaaacccaaaactcagggaggaacaggaggcagcccggcgccgccagcagcgcgagagcaagagcaacgcggcacgcccactaagggcccagagggcaaggtggccggccccgccgacgcccccatggactctggtgctgaggaagagaaggcgggagcagccaccgtgaagaagccgtctccctccaaagcccgcaagaagaagctaaacaagaaggggaggaagatggctggccgcaagcgcgggcgccccaagaagatgaacactgcgaaccccgagcggaagcccaagaagaaccaaagtgcagcggcactcccccaacccgctgctggtggcgcccaccccgcccgcgctgcagaagcttctagagtccttcaagatccagtacctgcagttcctggcatacacaaagaccccccagtacaaggccagcctgcaggagctgctgggccaggagaaggagaagaacgcccagctcctgggtgcggctcagcagctcctcagccactgccaggcccagaaggaggagatcaggaggctgtttcagcaaaaattggatgagctgggtgtgaaggcgctgacctacaacgacctgattcaagcgcagaaggagatctccgcccataaccagcagctgcgggagcagtcggagcagctggagcaggacaaccgcgcgctccgcggccagagcttgcagctgctcaaggctcgctgcgaggagctgcagctggactgggccacgctgtcgctggagaagctgttgaaggagaagcaggccctgaagagccagatctcggagaagcagaggcactgcctggagctgcagatcagcattgtggagctagagaagagccagcggcagcaggagctcctgcagctcaagtcctgtgtgccgcctgacgacgccctgtccctgcacctgcgtgggaagggcgccctgggccgcgagctggagcctgacgccagccggctgcacctggagctggactgcaccaagttctcgctgcctcacttgagcagcatgagcccggagctctccatgaacggccaggctgctggctatgagctctgcggtgtgctgagccggccttcgtcgaagcagaacacgccccagtacctggcctcacccctggaccaggaggtggtgccctgtacccctagccacgtcggccggccgcgcctggagaagctgtctggcctagccgcacccgactacactaggctgtccccggccaagattgtgctgaggcggcacctgagccaggaccacacggtgcccggcaggccggctgccagtgagctgcattcgagagctgagcacaccaaggagaacggccttccctaccagagccccagcgtgcctggcagcatgaagctgagccctcaggacccgcggcccctgtcccctggggccttgcagcttgctggagagaagagcagtgagaagggcctgagagagcgcgcctacggcagcagcggggagctcatcaccagcctgcccatcagcatcccgctcagcaccgtgcagcccaacaagctcccggtcagcattcccctggccagcgtggtgctgcccagccgcgccgagagggcgaggagcacccccagtcccgtgctgcagccccgtgacccctcgtccacacttgaaaagcagattggtgctaatgcccacggtgctgggagcagaagccttgccctggcccccgcaggcttctcctacgctggctcggtggccatcagcggggccttggcgggcagcccggcctctctcacacctggagccgagccggccaccttggatgagtcctccagctctgggagcctttttgccaccgtggggtcccgcagctccacgccacagcaccccctgctgctggcacagccccggaactcgcttcctgcctctcccgcccaccagctctcctccagtccccggcttggtggggccgcccagggcccgttgcccgaggccagcaagggagacctgccctccgattccggcttctcagatcctgagagtgaagccaagaggaggattgtgttcaccatcaccactggtgcgggcagtgccaagcagtcgccctccagcaagcacagccccctgaccgccagcgcccgtggggactgtgtgccgagccacgggcaggacagtcgcaggcgcggccggcggaagcgagcatctgcggggacgcccagcttgagcgcaggcgtgtcccccaagcgccgagccctgccgtccgtcgctggccttttcacacagccttcggggtctcccctcaacctcaactccatggtcagtaacatcaaccagcccctggagattacagccatctcgtccccggagacctccctgaagagctcccctgtgccctaccaggaccacgaccagccccccgtgctcaagaaggagcggcctctgagccagaccaatggggcacactactccccactcacctcagacgaggagccaggctctgaggacgagcccagcagtgctcgaattgagagaaaaattgcaacaatctccttagaaagcaaatctcccccgaaaaccttggaaaatggtggtggcttggcgggaaggaagcccgcgcccgccggcgagccagtcaatagcagcaagtggaagtccaccttctcgcccatctccgacatcggcctggccaagtcggcggacagcccgctgcaggccagctccgccctcagccagaactccctgttcacgttccggcccgccctggaggagccctctgccgatgccaagctggccgctcaccccaggaaaggctttcccggctccctgtcgggggctgacggactcagcccgggcaccaaccctgccaacggctgcaccttcggcgggggcctggccgcggacctgagtttacacagcttcagtgatggtgcttctcttccccacaagggccccgaggcggccggcctgagctccccgctgagcttcccctcgcagcgcggcaaggagggctcggacgccaaccctttcctgagcaagaggcagctggacggcctggctgggctgaagggcgagggcagccgcggcaaggaggcaggggagggcggcctaccgctgtgcgggcccacggacaagaccccactgctgagcggcaaggccgccaaggcccgggaccgcgaggtcgacctcaagaatggccacaacctcttcatctctgcggcggccgtgcctcccggaagcctcctcagcggccccggcctggccccggcggcgtcctccgcaggcggcgcggcgtcctccgcccagacgcaccggtccttcctgggccccttcccgccgggaccgcagttcgcgctcggccccatgtccctgcaggccaacctcggctccgtggccggctcctccgtgctgcagtcgctgttcagctctgtgccggccgccgcaggcctggtgcacgtgtcgtccgctgccaccagactgaccaactcgcacgccatgggcagcttttccggggtggcaggcggcacagttggaggtgtctttaaccacgcggtgccctccgcctctgctcatccgtttggagcccgtgtcggccgcggggctgcatgtggcagcgccacactgggcccgagcccgctgcaggcggcggccagcgcctcggcctcttcctttcaggccccggcctcggttgagacccggccgccccctccgcctccgcctccgcctcccccgctgcccccgcctgcgcacctgggccggtcccccgcggggccgcccgtcctccacgccccccctccacctaacgccgccttgcctcctcccccaacgctgctggcctctaaccctgagcccgcgcttctgcagagcctcgcgtccctcccgcctaaccaagctttcttgccccccacctctgctgcctctctgccgcctgctaacgcctctttgtctatcaagctcacctccctcccgcacaagggcgcccgcccctccttcacggtgcaccaccagcccctgccccggctggccctggcccaggccgcgcccgggatcccacaggccagcgccacggggccgtccgcggtgtgggtgtccctcggcatgccgcctccctatgccgcgcacctttcgggggttaagccgcgataaagaccttgcttagctagcagtgcgtattgtgtaaggtaaggccagagccctgcgcggtggctcactccagacactgaactgtccttcctttggcagagaagacggccacagggctcggcagaagttccgggggtcctgaggagggaagagggagagagccagggagaccagggagatggtcgcgagaggagggactacaggacgggcaccagccatggagtggcctgagtgtgttgggttccagctgcccgcagctgggttcctgcggtgacgccgcaggactgaggccagccctgggggcagctgtgccagcccctgtgggcgaggctcacggggtgccaggccagggggctgggagctctagctcctagagcagtctccagggctccatccgcaccaggcccaggtcactcatgacgggtggcgtggcttggtgctgttccccaggcgcccagcatgtagcaggcacggtgccggctgcagaggtcctggagagccagggtggctggctggatgcctctggtcggggctgtctggccagtagcctcggatgccctcatagggagccagtgaagccccaagtgccctgcctgcctgggggctgatgggttcccggcggggtcgagaggcaagctctgtgccctgcgtgttgaggcccccttgctggacacggctgatggccacactgccctgtggtcatggcccacagccgaggggctttcagctgctcagatgtcagcaccaagctgggcaggttagtgtagacggtgcccacctttgagaccagaaggaagttggaagcaggagtgattttgatgatgtgaggccttcagggaatgtcctgttcactcctcccccaagaggctgtggagactgtggccgctgacccctgagggcagttggccacccgtgccctccagggacatggcgtgcctggcggcgtagtgcaaaggtgccctctgcttgcccctggccttctgcctcaggggcccctgggacacaggccttcctgggcgagtccaaagcccaccgggcaaggagaggaggactgggagccaggagccaaggcggaggctgtggccagggctggtcagcctggcgggtcaatgcgggcacctgcgggctggacaagctatgctgggtctcttaggagatgagctgcaggtagggtggctttagctggactcggctgtgtgtctcctttggaggaaggctggagcttggccggcgtgtccaggtgtcaggctccctggtctgtcacggggcacgcccgtcgtctgttgtggttagaggagctggcactatgcctgtcatggtgctggccccaggtggcgtgtgtgctcgtgggaggcctcggtccccagcctgggtgagtgttgggctcccccaggcgcgatggtaacctcaggccgctcttcccgctgtgcccttctgcaggtaactaggatttctacctcaaccgcgagacctatgcaaggacggtgtggaccaactcgcgcccgcggcatggtgcccgccggcctgccgggctcccacccctggacggcagaggcaaggacggacgggagctccactgtgaatcggcggcacgcgccgcaggaggctgggactggtccagtttgtactgtcgatagttttagataaagtatttatcattttttaaaaagtataaacaattctgacttattttattccatctaagtggtaaaaggcaacttattgagaaatataaatatctatatatgagagctctatataaagaaaaagcgaggggaaaaaaccttatttattcaaacagtgcacaaaatggccccagcgtcagccccgaccctagacccctcagttgcagctcccagcagcccagacagagctgccggcgcccctgcctgcccaagaatcgctatcctgttagtggaccagagacctggcagcggatttcatatggaagcctgtgtgcatggtatcatagctatccttgcgttaggcgcgcgtgtggctgcgagtgcccgcggtgttgcacctagcctggttgacaccttgagactcgttcgtcttggcctcgctcatgggcgcgcccaggggggtgcactggttcgcgtgccgcccccattgtccgtgctggtgctttgtgacgtgcgatgaccttcgtgcgcaccctgagggttggttggcgacatgggatgatgagtcggcctggagtgcccaggagggttggtagcagagaggaagaagccatggggccatcattcggaaactgcttggactgtgttatgccacctgtgtggccatttaaaggggtcacatgtaggtacaggctggagcacgatagcatgtggtgcatggagagcatagcaacgaggagggatatgg

SEQ ID NO: 369431 - DNA, 3482 bp, Homo sapiens
gcggccgcgcgcgcggacatgggggagaagctggagctgagactgaagtcgcccgtgggggctgagcccgccgtctacccgtggccgctgccggtctacgataaacatcacgatgctgctcatgaaatcatcgagaccatccgatgggtctgtgaagaaatcccggatctcaagctcgctatggagaattacgttttaattgactatgacaccaaaagcttcgagagcatgcagaggctctgcgacaagtacaaccgtgccatcgacagcatccaccagctgtggaagggcaccacgcagcccatgaagctgaacacgcggccgtccactggactcctgcgccatatcctgcagcaggtctacaaccactcggtgaccgaccccgagaagctcaacaactacgagcccttctcccccgaggtgtacggggagacctccttcgacctggtggcccagatgattgatgagatcaagatgaccgacgacgacctgtttgtggacttggggagcggtgtgggccaggtcgtgctccaggttgctgctgccaccaactgcaaacatcactatggcgtcgagaaagcagacatcccggccaagtatgcggagaccatggaccgcgagttcaggaagtggatgaaatggtatggaaaaaagcatgcagaatacacattggagagaggcgatttcctctcagaagagtggagggagcgaatcgccaacacgagtgttatatttgtgaataattttgcctttggtcctgaggtggatcaccagctgaaggagcggtttgcaaacatgaaggaaggtggcagaatcgtgtcctcgaaaccctttgcacctctgaacttcagaataaacagtagaaacttgagtgacatcggcaccatcatgcgcgtggtggagctctcgcccctgaagggctcggtgtcgtggacggggaagccagtctcctactacctgcacactatcgaccgcaccatacttgaaaactatttttctagtctgaaaaacccaaaactcagggaggaacaggaggcagcccggcgccgccagcagcgcgagagcaagagcaacgcggcacgcccactaagggcccagagggcaaggtggccggccccgccgacgcccccatggactctggtgctgaggaagagaaggcgggagcagccaccgtgaagaagccgtctccctccaaagcccgcaagaagaagctaaacaagaaggggaggaagatggctggccgcaagcgcgggcgccccaagaagatgaacactgcgaaccccgagcggaagcccaagaagaaccaaagtgcagcggcactcccccaacccgctgctggtggcgcccaccccgcccgcgctgcagaagcttctagagtccttcaagatccagtacctgcagttcctggcatacacaaagaccccccagtacaaggccagcctgcaggagctgctgggccaggagaaggagaagaacgcccagctcctgggtgcggctcagcagctcctcagccactgccaggcccagaaggaggagatcaggaggctgtttcagcaaaaattggatgagctgggtgtgaaggcgctgacctacaacgacctgattcaagcgcagaaggagatctccgcccataaccagcagctgcgggagcagtcggagcagctggagcaggacaaccgcgcgctccgcggccagagcttgcagctgctcaaggctcgctgcgaggagctgcagctggactgggccacgctgtcgctggagaagctgttgaaggagaagcaggccctgaagagccagatctcggagaagcagaggcactgcctggagctgcagatcagcattgtggagctagagaagagccagcggcagcaggagctcctgcagctcaagtcctgtgtgccgcctgacgacgccctgtccctgcacctgcgtgggaagggcgccctgggccgcgagctggagcctgacgccagccggctgcacctggagctggactgcaccaagttctcgctgcctcacttgagcagcatgagcccggagctctccatgaacggccaggctgctggctatgagctctgcggtgtgctgagccggccttcgtcgaagcagaacacgccccagtacctggcctcacccctggaccaggaggtggtgccctgtacccctagccacgtcggccggccgcgcctggagaagctgtctggcctagccgcacccgactacactaggctgtccccggccaagattgtgctgaggcggcacctgagccaggaccacacggtgcccggcaggccggctgccagtgagctgcattcgagagctgagcacaccaaggagaacggccttccctaccagagccccagcgtgcctggcagcatgaagctgagccctcaggacccgcggcccctgtcccctggggccttgcagcttgctggagagaagagcagtgagaagggcctgagagagcgcgcctacggcagcagcggggagctcatcaccagcctgcccatcagcatcccgctcagcaccgtgcagcccaacaagctcccggtcagcattcccctggccagcgtggtgctgcccagccgcgccgagagggcgaggagcacccccagtcccgtgctgcagccccgtgacccctcgtccacacttgaaaagcagattggtgctaatgcccacggtgctgggagcagaagccttgccctggcccccgcaggcttctcctacgctggctcggtggccatcagcggggccttggcgggcagcccggcctctctcacacctggagccgagccggccaccttggatgagtcctccagctctgggagcctttttgccaccgtggggtcccgcagctccacgccacagcaccccctgctgctggcacagccccggaactcgcttcctgcctctcccgcccaccagctctcctccagtccccggcttggtggggccgcccagggcccgttgcccgaggccagcaagggagacctgccctccgattccggcttctcagatcctgagagtgaagccaagaggaggattgtgttcaccatcaccactggtgcgggcagtgccaagcagtcgccctccagcaagcacagccccctgaccgccagcgcccgtggggactgtgtgccgagccacgggcaggacagtcgcaggcgcggccggcggaagcgagcatctgcggggacgcccagcttgagcgcaggcgtgtcccccgtgctcaagaaggagcggcctctgagccagaccaatggggcacactactccccactcaactccatggtcagtaacatcaaccagcccctggagattacagccatctcgtccccggagacctccctgaagagctcccctgtgccctaccaggaccactgtgaatcggcggcacgcgccgcaggaggctgggactggtccagtttgtactgtcgatagttttagataaagtatttatcattttttaaaaagtataaaca

SEQ ID NO: 369432 - DNA, 2640 bp, Homo sapiens
gcggccgcgcgcgcggacatgggggagaagctggagctgagactgaagtcgcccgtgggggctgagcccgccgtctacccgtggccgctgccggtctacgataaacatcacgatgctgctcatgaaatcatcgagaccatccgatgggtctgtgaagaaatcccggatctcaagctcgctatggagaattacgttttaattgactatgacaccaaaagcttcgagagcatgcagaggctctgcgacaagtacaaccgtgccatcgacagcatccaccagctgtggaagggcaccacgcagcccatgaagctgaacacgcggccgtccactggactcctgcgccatatcctgcagcaggtctacaaccactcggtgaccgaccccgagaagctcaacaactacgagcccttctcccccgaggtgtacggggagacctccttcgacctggtggcccagatgattgatgagatcaagatgaccgacgacgacctgtttgtggacttggggagcggtgtgggccaggtcgtgctccaggttgctgctgccaccaactgcaaacatcactatggcgtcgagaaagcagacatcccggccaagtatgcggagaccatggaccgcgagttcaggaagtggatgaaatggtatggaaaaaagcatgcagaatacacattggagagaggcgatttcctctcagaagagtggagggagcgaatcgccaacacgagtgttatatttgtgaataattttgcctttggtcctgaggtggatcaccagctgaaggagcggtttgcaaacatgaaggaaggtggcagaatcgtgtcctcgaaaccctttgcacctctgaacttcagaataaacagtagaaacttgagtgacatcggcaccatcatgcgcgtggtggagctctcgcccctgaagggctcggtgtcgtggacggggaagccagtctcctactacctgcacactatcgaccgcaccatacttgaaaactatttttctagtctgaaaaacccaaaactcagggaggaacaggaggcagcccggcgccgccagcagcgcgagagcaagagcaacgcggcacgcccactaagggcccagagggcaaggtggccggccccgccgacgcccccatggactctggtgctgaggaagagaaggcgggagcagccaccgtgaagaagccgtctccctccaaagcccgcaagaagaagctaaacaagaaggggaggaagatggctggccgcaagcgcgggcgccccaagaagatgaacactgcgaaccccgagcggaagcccaagaagaaccaaagtgcagcggcactcccccaacccgctgctggtggcgcccaccccgcccgcgctgcagaagcttctagagtccttcaagatccagtacctgcagttcctggcatacacaaagaccccccagtacaaggccagcctgcaggagctgctgggccaggagaaggagaagaacgcccagctcctgggtgcggctcagcagctcctcagccactgccaggcccagaaggaggagatcaggaggctgtttcagcaaaaattggatgagctgggtgtgaaggcgctgacctacaacgacctgattcaagcgcagaaggagatctccgcccataaccagcagctgcgggagcagtcggagcagctggagcaggacaaccgcgcgctccgcggccagagcttgcagctgctcaaggctcgctgcgaggagctgcagctggactgggccacgctgtcgctggagaagctgttgaaggagaagcaggccctgaagagccagatctcggagaagcagaggcactgcctggagctgcagatcagcattgtggagctagagaagagccagcggcagcaggagctcctgcagctcaagtcctgtgtgccgcctgacgacgccctgtccctgcacctgcgtgggaagggcgccctgggccgcgagctggagcctgacgccagccggctgcacctggagctggactgcaccaagttctcgctgcctcacttgagcagcatgagcccggagctctccatgaacggccaggctgctggctatgagctctgcggtgtgctgagccggccttcgtcgaagcagaacacgccccagtacctggcctcacccctggaccaggaggtggtgccctgtacccctagccacgtcggccggccgcgcctggagaagctgtctggcctagccgcacccgactacactaggctgtccccggccaagattgtgctgaggcggcacctgagccaggaccacacggtgcccggcaggccggctgccagtgagctgcattcgagagctgagcacaccaaggagaacggccttccctaccagagccccagcgtgcctggcagcatgaagctgagccctcaggacccgcggcccctgtcccctggggccttgcagcttgctggagagaagagcagtgagaagggcctgagagaacgcgcctaatattaggcgcgttctgcgtggagaatactttttgcgatgcctactggagactttgattcgatacgcccagttgggccgaccaggtcgaggaggagggggaggacgacaaatgtgtcaccagcgagctcctcacggggatccctctggccacaggtgacaccagcc

SEQ ID NO: 369433 - DNA, 191 bp, Homo sapiens
cccgctcaagttcccccgctgccctcttcccacgcggtactggacggtgaccccggcggcctcccccagccagctgcaggcctcaacactcactgtttccagctgggttctgggtctcctggggcacctgctgcccctgacacacagggttttctctctgcagaggagcacccccagtcccgtgctgcagc

SEQ ID NO: 369434 - DNA, 446 bp, Homo sapiens
acaaaacacaaaacaaaacaaaaaaaaccaaacccttcctgatcgtttctgctgctgtgtttcagatgggtctgtgaagaaatcccggatctcaagctcgctatggagaattacgttttaattgactatgacaccaaaaggtaagcagagtcctgtccagccgctccgctccgaggacagactcggctcttggggaggacaggaggacgcatcctataattagctcttcttagatggtgcaagctgatctgaaatttccttttagagttggccgtggccaccataaagttattttggtaggaaatgtttatcaactcttggcaaaggctgtcagaggccggacagaattggaaactccggttgtggaaagtgggattggcatgtgtggagtcagcccgcgctagtgatcgctctttttatagcgggcggctgacggccagaagtcc

SEQ ID NO: 369435 - DNA, 301 bp, Homo sapiens
gcggccgcgcgcgcggacatgggggagaagctggagctgagactgaagtcgcccgtgggggctgagcccgccgtctacccgtggccgctgccggtctacgataaacatcacgatgctgctcatgaaatcatcgagaccatccgatgggtctgtgaagaaatcccggatctcaagctcgctatggagaattacgttttaattgactatgacaccaaaagctgctggttaaggaaaacatgaacttggcctgtggagcactggttttcctatgaggaaggggaagtgtgaacctcggcacatg

SEQ ID NO: 369436 - DNA, 7318 bp, Homo sapiens
gcggccgcgcgcgcggacatgggggagaagctggagctgagactgaagtcgcccgtgggggctgagcccgccgtctacccgtggccgctgccggtctacgataaacatcacgatgctgctcatgaaatcatcgagaccatccgatgggtctgtgaagaaatcccggatctcaagctcgctatggagaattacgttttaattgactatgacaccaaaagcttcgagagcatgcagaggctctgcgacaagtacaaccgtgccatcgacagcatccaccagctgtggaagggcaccacgcagcccatgaagctgaacacgcggccgtccactggactcctgcgccatatcctgcagcaggtctacaaccactcggtgaccgaccccgagaagctcaacaactacgagcccttctcccccgaggtgtacggggagacctccttcgacctggtggcccagatgattgatgagatcaagatgaccgacgacgacctgtttgtggacttggggagcggtgtgggccaggtcgtgctccaggttgctgctgccaccaactgcaaacatcactatggcgtcgagaaagcagacatcccggccaagtatgcggagaccatggaccgcgagttcaggaagtggatgaaatggtatggaaaaaagcatgcagaatacacattggagagaggcgatttcctctcagaagagtggagggagcgaatcgccaacacgagtgttatatttgtgaataattttgcctttggtcctgaggtggatcaccagctgaaggagcggtttgcaaacatgaaggaaggtggcagaatcgtgtcctcgaaaccctttgcacctctgaacttcagaataaacagtagaaacttgagtgacatcggcaccatcatgcgcgtggtggagctctcgcccctgaagggctcggtgtcgtggacggggaagccagtctcctactacctgcacactatcgaccgcaccatacttgaaaactatttttctagtctgaaaaacccaaaactcagggaggaacaggaggcagcccggcgccgccagcagcgcgagagcaagagcaacgcggcacgcccactaagggcccagagggcaaggtggccggccccgccgacgcccccatggactctggtgctgaggaagagaaggcgggagcagccaccgtgaagaagccgtctccctccaaagcccgcaagaagaagctaaacaagaaggggaggaagatggctggccgcaagcgcgggcgccccaagaagatgaacactgcgaaccccgagcggaagcccaagaagaaccaaagtgcagcggcactcccccaacccgctgctggtggcgcccaccccgcccgcgctgcagaagcttctagagtccttcaagatccagtacctgcagttcctggcatacacaaagaccccccagtacaaggccagcctgcaggagctgctgggccaggagaaggagaagaacgcccagctcctgggtgcggctcagcagctcctcagccactgccaggcccagaaggaggagatcaggaggctgtttcagcaaaaattggatgagctgggtgtgaaggcgctgacctacaacgacctgattcaagcgcagaaggagatctccgcccataaccagcagctgcgggagcagtcggagcagctggagcaggacaaccgcgcgctccgcggccagagcttgcagctgctcaaggctcgctgcgaggagctgcagctggactgggccacgctgtcgctggagaagctgttgaaggagaagcaggccctgaagagccagatctcggagaagcagaggcactgcctggagctgcagatcagcattgtggagctagagaagagccagcggcagcaggagctcctgcagctcaagtcctgtgtgccgcctgacgacgccctgtccctgcacctgcgtgggaagggcgccctgggccgcgagctggagcctgacgccagccggctgcacctggagctggactgcaccaagttctcgctgcctcacttgagcagcatgagcccggagctctccatgaacggccaggctgctggctatgagctctgcggtgtgctgagccggccttcgtcgaagcagaacacgccccagtacctggcctcacccctggaccaggaggtggtgccctgtacccctagccacgtcggccggccgcgcctggagaagctgtctggcctagccgcacccgactacactaggctgtccccggccaagattgtgctgaggcggcacctgagccaggaccacacggtgcccggcaggccggctgccagtgagctgcattcgagagctgagcacaccaaggagaacggccttccctaccagagccccagcgtgcctggcagcatgaagctgagccctcaggacccgcggcccctgtcccctggggccttgcagcttgctggagagaagagcagtgagaagggcctgagagagcgcgcctacggcagcagcggggagctcatcaccagcctgcccatcagcatcccgctcagcaccgtgcagcccaacaagctcccggtcagcattcccctggccagcgtggtgctgcccagccgcgccgagagggcgaggagcacccccagtcccgtgctgcagccccgtgacccctcgtccacacttgaaaagcagattggtgctaatgcccacggtgctgggagcagaagccttgccctggcccccgcaggcttctcctacgctggctcggtggccatcagcggggccttggcgggcagcccggcctctctcacacctggagccgagccggccaccttggatgagtcctccagctctgggagcctttttgccaccgtggggtcccgcagctccacgccacagcaccccctgctgctggcacagccccggaactcgcttcctgcctctcccgcccaccagctctcctccagtccccggcttggtggggccgcccagggcccgttgcccgaggccagcaagggagacctgccctccgattccggcttctcagatcctgagagtgaagccaagaggaggattgtgttcaccatcaccactggtgcgggcagtgccaagcagtcgccctccagcaagcacagccccctgaccgccagcgcccgtggggactgtgtgccgagccacgggcaggacagtcgcaggcgcggccggcggaagcgagcatctgcggggacgcccagcttgagcgcaggcgtgtcccccaagcgccgagccctgccgtccgtcgctggccttttcacacagccttcggggtctcccctcaacctcaactccatggtcagtaacatcaaccagcccctggagattacagccatctcgtccccggagacctccctgaagagctcccctgtgccctaccaggaccacgaccagccccccgtgctcaagaaggagcggcctctgagccagaccaatggggcacactactccccactcacctcagacgaggagccaggctctgaggacgagcccagcagtgctcgaattgagagaaaaattgcaacaatctccttagaaagcaaatctcccccgaaaaccttggaaaatggtggtggcttggcgggaaggaagcccgcgcccgccggcgagccagtcaatagcagcaagtggaagtccaccttctcgcccatctccgacatcggcctggccaagtcggcggacagcccgctgcaggccagctccgccctcagccagaactccctgttcacgttccggcccgccctggaggagccctctgccgatgccaagctggccgctcaccccaggaaaggctttcccggctccctgtcgggggctgacggactcagcccgggcaccaaccctgccaacggctgcaccttcggcgggggcctggccgcggacctgagtttacacagcttcagtgatggtgcttctcttccccacaagggccccgaggcggccggcctgagctccccgctgagcttcccctcgcagcgcggcaaggagggctcggacgccaaccctttcctgagcaagaggcagctggacggcctggctgggctgaagggcgagggcagccgcggcaaggaggcaggggagggcggcctaccgctgtgcgggcccacggacaagaccccactgctgagcggcaaggccgccaaggcccgggaccgcgaggtcgacctcaagaatggccacaacctcttcatctctgcggcggccgtgcctcccggaagcctcctcagcggccccggcctggccccggcggcgtcctccgcaggcggcgcggcgtcctccgcccagacgcaccggtccttcctgggccccttcccgccgggaccgcagttcgcgctcggccccatgtccctgcaggccaacctcggctccgtggccggctcctccgtgctgcagtcgctgttcagctctgtgccggccgccgcaggcctggtgcacgtgtcgtccgctgccaccagactgaccaactcgcacgccatgggcagcttttccggggtggcaggcggcacagttggaggtaactaggatttctacctcaaccgcgagacctatgcaaggacggtgtggaccaactcgcgcccgcggcatggtgcccgccggcctgccgggctcccacccctggacggcagaggcaaggacggacgggagctccactgtgaatcggcggcacgcgccgcaggaggctgggactggtccagtttgtactgtcgatagttttagataaagtatttatcattttttaaaaagtataaacaattctgacttattttattccatctaagtggtaaaaggcaacttattgagaaatataaatatctatatatgagagctctatataaagacacgtgtctgcagggcgggcccgccagcggattcgccacagcctgccccggtgctatctcgtccccaggcccgcgcctgcctccacccgcttggtgctgactagacgctgacaacgccgaaccccgttctcggaaacgccgcccggccggctcccccgacgcgctgctcccgtaccaaaggcaggcccgtcgccaccacattcctcggaggcctccccgcggcctgagccccttcctgagcgccctggcgcctgccctgagctcttcacctttaccccggcactgtgaacccccagactgttcaccctccggggcgtgggttgcgcccttgcatgtgaaggggcctgcgcggtgacgcagctggccatgtgctgcgcgatggtgctgtgaggacggcgcgggcacgttgaacaagtgcatttacttttgtatttctcggctgtccatggctcgcagcatgccctgcgatgcggggcaggcctgtcgtgggtcccttggtgtttctgtacaggagagagtcacactaatgagtggcagtattttatagagatgtgatgagaatttataaatttcatagatttgacagcttttatttttagatggtataatgcacagtgaagaggaaagaaaagcgaggggaaaaaaccttatttattcaaacagtgcacaaaatggccccagcgtcagccccgaccctagacccctcagttgcagctcccagcagcccagacagagctgccggcgcccctgcctgccccacatcccttcctgtcagggccacgcctggcacccatcccttggagcctgtgctggttctcccagctgctgtgggtgtgctggggccagggtgcactgctgaaacctggcctctctggccctaggccccagggtgacgtcggccccccactctgcagccttggcgggtgcctgggactgggtgtggaaggagaggagctgaggccggggtgtagcaggcaggcagggccactccagtgcttctggagccctgagcagtcagggcctgggttgtctgagcagtggtggctctgtgccctccctggaggatgggatctgggagtctgagctccccgcatctggccctgggctgtgtggcacttgctgagcccaccttctcaagtgcttgctcctgtgagatggcatcggggagccccttccccaaggtgccacagatccaccctccagggagctgccagccctgtgttctggttcccaagggcaggatggacacacgtcacatccctaccacgtggcctccaaagggagccacggaggaaaggcttctgtggttgctaggtgggggagtcctgtgtgggagggcctgaagacccctgcttgtgcctggtgaggggggtgctgcctcccccagcccccaacaacctctcagacccccaccctccaacatagctgagttctgaagatggtgctccggacctgtcctcttaagtggtgcccagtgccctccccaccccacgttggtgctctcagctagaaggtgctgtgcctctgcctgagccccaagccccgagcctggccttcaggacaggcagcctgctctgtgtcgccacgggccggatacgccacagggttgatggcagagacggccgagtccctggtctagaacaagacacattctttaaacactgtattacttctgcctccctctaggtgacagtggcagtccgggtgccatcacgggtcctgcagatggccatgcagggctcctgcccacgcaggccaccgtatgttcaggacacgcactgggtctcagagccactggcccaggcagaagtctccttgagcccactgggtcatatgcgtgtcaccacacgtgaactagtgtggtggctgcctgcggacaccctcctgttctgagccctgggcctgtgttcttctcagacactcccagactgaggggtggtgtgtggcgggtggcagggtggctgtggagactggggatctggagcctggtgctggcacctggcctgagtttccgtgggcagctggcggggacctgtgctgctgctgctgactgtgggtgggcgggcggcgcctgggagtggctcttgctcaggaattgataggaaccctaaaaactaggataccccctcctcggcccatgaggcacgcacagtgacttatttaagacttcccccttaatttatctgcccccaggatgcgtcagtctgttcagtggtcagcaggccccccaccccccgccgactgccctcgccatcgtggtcagacccccctcccaacacaacacgctgctggtctgtgtcagcctttgtaacgtgggaggctctgccgtgtcttccgggtgaactgtatttggattgcgcgcattgtcacggtccgcccctgggctgcaggcgccccttcctctgggcacccctgcattctgcatccccacctctagacgctgtaataaacagactgttttcactcggaaaaaaaat

SEQ ID NO: 369437 - DNA, 9255 bp, Homo sapiens
gcggccgcgcgcgcggacatgggggagaagctggagctgagactgaagtcgcccgtgggggctgagcccgccgtctacccgtggccgctgccggtctacgataaacatcacgatgctgctcatgaaatcatcgagaccatccgatgggtctgtgaagaaatcccggatctcaagctcgctatggagaattacgttttaattgactatgacaccaaaagcttcgagagcatgcagaggctctgcgacaagtacaaccgtgccatcgacagcatccaccagctgtggaagggcaccacgcagcccatgaagctgaacacgcggccgtccactggactcctgcgccatatcctgcagcaggtctacaaccactcggtgaccgaccccgagaagctcaacaactacgagcccttctcccccgaggtgtacggggagacctccttcgacctggtggcccagatgattgatgagatcaagatgaccgacgacgacctgtttgtggacttggggagcggtgtgggccaggtcgtgctccaggttgctgctgccaccaactgcaaacatcactatggcgtcgagaaagcagacatcccggccaagtatgcggagaccatggaccgcgagttcaggaagtggatgaaatggtatggaaaaaagcatgcagaatacacattggagagaggcgatttcctctcagaagagtggagggagcgaatcgccaacacgagtgttatatttgtgaataattttgcctttggtcctgaggtggatcaccagctgaaggagcggtttgcaaacatgaaggaaggtggcagaatcgtgtcctcgaaaccctttgcacctctgaacttcagaataaacagtagaaacttgagtgacatcggcaccatcatgcgcgtggtggagctctcgcccctgaagggctcggtgtcgtggacggggaagccagtctcctactacctgcacactatcgaccgcaccatacttgaaaactatttttctagtctgaaaaacccaaaactcagggaggaacaggaggcagcccggcgccgccagcagcgcgagagcaagagcaacgcggcacgcccactaagggcccagagggcaaggtggccggccccgccgacgcccccatggactctggtgctgaggaagagaaggcgggagcagccaccgtgaagaagccgtctccctccaaagcccgcaagaagaagctaaacaagaaggggaggaagatggctggccgcaagcgcgggcgccccaagaagatgaacactgcgaaccccgagcggaagcccaagaagaaccaaagtgcagcggcactcccccaacccgctgctggtggcgcccaccccgcccgcgctgcagaagcttctagagtccttcaagatccagtacctgcagttcctggcatacacaaagaccccccagtacaaggccagcctgcaggagctgctgggccaggagaaggagaagaacgcccagctcctgggtgcggctcagcagctcctcagccactgccaggcccagaaggaggagatcaggaggctgtttcagcaaaaattggatgagctgggtgtgaaggcgctgacctacaacgacctgattcaagcgcagaaggagatctccgcccataaccagcagctgcgggagcagtcggagcagctggagcaggacaaccgcgcgctccgcggccagagcttgcagctgctcaaggctcgctgcgaggagctgcagctggactgggccacgctgtcgctggagaagctgttgaaggagaagcaggccctgaagagccagatctcggagaagcagaggcactgcctggagctgcagatcagcattgtggagctagagaagagccagcggcagcaggagctcctgcagctcaagtcctgtgtgccgcctgacgacgccctgtccctgcacctgcgtgggaagggcgccctgggccgcgagctggagcctgacgccagccggctgcacctggagctggactgcaccaagttctcgctgcctcacttgagcagcatgagcccggagctctccatgaacggccaggctgctggctatgagctctgcggtgtgctgagccggccttcgtcgaagcagaacacgccccagtacctggcctcacccctggaccaggaggtggtgccctgtacccctagccacgtcggccggccgcgcctggagaagctgtctggcctagccgcacccgactacactaggctgtccccggccaagattgtgctgaggcggcacctgagccaggaccacacggtgcccggcaggccggctgccagtgagctgcattcgagagctgagcacaccaaggagaacggccttccctaccagagccccagcgtgcctggcagcatgaagctgagccctcaggacccgcggcccctgtcccctggggccttgcagcttgctggagagaagagcagtgagaagggcctgagagagcgcgcctacggcagcagcggggagctcatcaccagcctgcccatcagcatcccgctcagcaccgtgcagcccaacaagctcccggtcagcattcccctggccagcgtggtgctgcccagccgcgccgagagggcgaggagcacccccagtcccgtgctgcagccccgtgacccctcgtccacacttgaaaagcagattggtgctaatgcccacggtgctgggagcagaagccttgccctggcccccgcaggcttctcctacgctggctcggtggccatcagcggggccttggcgggcagcccggcctctctcacacctggagccgagccggccaccttggatgagtcctccagctctgggagcctttttgccaccgtggggtcccgcagctccacgccacagcaccccctgctgctggcacagccccggaactcgcttcctgcctctcccgcccaccagctctcctccagtccccggcttggtggggccgcccagggcccgttgcccgaggccagcaagggagacctgccctccgattccggcttctcagatcctgagagtgaagccaagaggaggattgtgttcaccatcaccactggtgcgggcagtgccaagcagtcgccctccagcaagcacagccccctgaccgccagcgcccgtggggactgtgtgccgagccacgggcaggacagtcgcaggcgcggccggcggaagcgagcatctgcggggacgcccagcttgagcgcaggcgtgtcccccaagcgccgagccctgccgtccgtcgctggccttttcacacagccttcggggtctcccctcaacctcaactccatggtcagtaacatcaaccagcccctggagattacagccatctcgtccccggagacctccctgaagagctcccctgtgccctaccaggaccacgaccagccccccgtgctcaagaaggagcggcctctgagccagaccaatggggcacactactccccactcacctcagacgaggagccaggctctgaggacgagcccagcagtgctcgaattgagagaaaaattgcaacaatctccttagaaagcaaatctcccccgaaaaccttggaaaatggtggtggcttggcgggaaggaagcccgcgcccgccggcgagccagtcaatagcagcaagtggaagtccaccttctcgcccatctccgacatcggcctggccaagtcggcggacagcccgctgcaggccagctccgccctcagccagaactccctgttcacgttccggcccgccctggaggagccctctgccgatgccaagctggccgctcaccccaggaaaggctttcccggctccctgtcgggggctgacggactcagcccgggcaccaaccctgccaacggctgcaccttcggcgggggcctggccgcggacctgagtttacacagcttcagtgatggtgcttctcttccccacaagggccccgaggcggccggcctgagctccccgctgagcttcccctcgcagcgcggcaaggagggctcggacgccaaccctttcctgagcaagaggcagctggacggcctggctgggctgaagggcgagggcagccgcggcaaggaggcaggggagggcggcctaccgctgtgcgggcccacggacaagaccccactgctgagcggcaaggccgccaaggcccgggaccgcgaggtcgacctcaagaatggccacaacctcttcatctctgcggcggccgtgcctcccggaagcctcctcagcggccccggcctggccccggcggcgtcctccgcaggcggcgcggcgtcctccgcccagacgcaccggtccttcctgggccccttcccgccgggaccgcagttcgcgctcggccccatgtccctgcaggccaacctcggctccgtggccggctcctccgtgctgcagtcgctgttcagctctgtgccggccgccgcaggcctggtgcacgtgtcgtccgctgccaccagactgaccaactcgcacgccatgggcagcttttccggggtggcaggcggcacagttggaggtgtctttaaccacgcggtgccctccgcctctgctcatccgtttggagcccgtgtcggccgcggggctgcatgtggcagcgccacactgggcccgagcccgctgcaggcggcggccagcgcctcggcctcttcctttcaggccccggcctcggttgagacccggccgccccctccgcctccgcctccgcctcccccgctgcccccgcctgcgcacctgggccggtcccccgcggggccgcccgtcctccacgccccccctccacctaacgccgccttgcctcctcccccaacgctgctggcctctaaccctgagcccgcgcttctgcagagcctcgcgtccctcccgcctaaccaagctttcttgccccccacctctgctgcctctctgccgcctgctaacgcctctttgtctatcaagctcacctccctcccgcacaagggcgcccgcccctccttcacggtgcaccaccagcccctgccccggctggccctggcccaggccgcgcccgggatcccacaggccagcgccacggggccgtccgcggtgtgggtgtccctcggcatgccgcctccctatgccgcgcacctttcgggggttaagccgcgataaagaccttgcttagctagcagtgcgtattgtgtaaggtaaggccagagccctgcgcggtggctcactccagacactgaactgtccttcctttggcagagaagacggccacagggctcggcagaagttccgggggtcctgaggagggaagagggagagagccagggagaccagggagatggtcgcgagaggagggactacaggacgggcaccagccatggagtggcctgagtgtgttgggttccagctgcccgcagctgggttcctgcggtgacgccgcaggactgaggccagccctgggggcagctgtgccagcccctgtgggcgaggctcacggggtgccaggccagggggctgggagctctagctcctagagcagtctccagggctccatccgcaccaggcccaggtcactcatgacgggtggcgtggcttggtgctgttccccaggcgcccagcatgtagcaggcacggtgccggctgcagaggtcctggagagccagggtggctggctggatgcctctggtcggggctgtctggccagtagcctcggatgccctcatagggagccagtgaagccccaagtgccctgcctgcctgggggctgatgggttcccggcggggtcgagaggcaagctctgtgccctgcgtgttgaggcccccttgctggacacggctgatggccacactgccctgtggtcatggcccacagccgaggggctttcagctgctcagatgtcagcaccaagctgggcaggttagtgtagacggtgcccacctttgagaccagaaggaagttggaagcaggagtgattttgatgatgtgaggccttcagggaatgtcctgttcactcctcccccaagaggctgtggagactgtggccgctgacccctgagggcagttggccacccgtgccctccagggacatggcgtgcctggcggcgtagtgcaaaggtgccctctgcttgcccctggccttctgcctcaggggcccctgggacacaggccttcctgggcgagtccaaagcccaccgggcaaggagaggaggactgggagccaggagccaaggcggaggctgtggccagggctggtcagcctggcgggtcaatgcgggcacctgcgggctggacaagctatgctgggtctcttaggagatgagctgcaggtagggtggctttagctggactcggctgtgtgtctcctttggaggaaggctggagcttggccggcgtgtccaggtgtcaggctccctggtctgtcacggggcacgcccgtcgtctgttgtggttagaggagctggcactatgcctgtcatggtgctggccccaggtggcgtgtgtgctcgtgggaggcctcggtccccagcctgggtgagtgttgggctcccccaggcgcgatggtaacctcaggccgctcttcccgctgtgcccttctgcaggtaactaggatttctacctcaaccgcgagacctatgcaaggacggtgtggaccaactcgcgcccgcggcatggtgcccgccggcctgccgggctcccacccctggacggcagaggcaaggacggacgggagctccactgtgaatcggcggcacgcgccgcaggaggctgggactggtccagtttgtactgtcgatagttttagataaagtatttatcattttttaaaaagtataaacaattctgacttattttattccatctaagtggtaaaaggcaacttattgagaaatataaatatctatatatgagagctctatataaagacacgtgtctgcagggcgggcccgccagcggattcgccacagcctgccccggtgctatctcgtaccaaaggcaggcccgtcgccaccacattcctcggaggcctccccgcggcctgagccccttcctgagcgccctggcgcctgccctgagctcttcacctttaccccggcactgtgaacccccagactgttcaccctccggggcgtgggttgcgcccttgcatgtgaaggggcctgcgcggtgacgcagctggccatgtgctgcgcgatggtgctgtgaggacggcgcgggcacgttgaacaagtgcatttacttttgtatttctcggctgtccatggctcgcagcatgccctgcgatgcggggcaggcctgtcgtgggtcccttggtgtttctgtacaggagagagtcacactaatgagtggcagtattttatagagatgtgatgagaatttataaatttcatagatttgacagcttttatttttagatggtataatgcacagtgaagaggaaagaaaagcgaggggaaaaaaccttatttattcaaacagtgcacaaaatggccccagcgtcagccccgaccctagacccctcagttgcagctcccagcagcccagacagagctgccggcgcccctgcctgccccacatcccttcctgtcagggccacgcctggcacccatcccttggagcctgtgctggttctcccagctgctgtgggtgtgctggggccagggtgcactgctgaaacctggcctctctggccctaggccccagggtgacgtcggccccccactctgcagccttggcgggtgcctgggactgggtgtggaaggagaggagctgaggccggggtgtagcaggcaggcagggccactccagtgcttctggagccctgagcagtcagggcctgggttgtctgagcagtggtggctctgtgccctccctggaggatgggatctgggagtctgagctccccgcatctggccctgggctgtgtggcacttgctgagcccaccttctcaagtgcttgctcctgtgagatggcatcggggagccccttccccaaggtgccacagatccaccctccagggagctgccagccctgtgttctggttcccaagggcaggatggacacacgtcacatccctaccacgtggcctccaaagggagccacggaggaaaggcttctgtggttgctaggtgggggagtcctgtgtgggagggcctgaagacccctgcttgtgcctggtgaggggggtgctgcctcccccagcccccaacaacctctcagacccccaccctccaacatagctgagttctgaagatggtgctccggacctgtcctcttaagtggtgcccagtgccctccccaccccacgttggtgctctcagctagaaggtgctgtgcctctgcctgagccccaagccccgagcctggccttcaggacaggcagcctgctctgtgtcgccacgggccggatacgccacagggttgatggcagagacggccgagtccctggtctagaacaagacacattctttaaacactgtattacttctgcctccctctaggtgacagtggcagtccgggtgccatcacgggtcctgcagatggccatgcagggctcctgcccacgcaggccaccgtatgttcaggacacgcactgggtctcagagccactggcccaggcagaagtctccttgagcccactgggtcatatgcgtgtcaccacacgtgaactagtgtggtggctgcctgcggacaccctcctgttctgagccctgggcctgtgttcttctcagacactcccagactgaggggtggtgtgtggcgggtggcagggtggctgtggagactggggatctggagcctggtgctggcacctggcctgagtttccgtgggcagctggcggggacctgtgctgctgctgctgactgtgggtgggcgggcggcgcctgggagtggctcttgctcaggaattgataggaaccctaaaaactaggataccccctcctcggcccatgaggcacgcacagtgacttatttaagacttcccccttaatttatctgcccccaggatgcgtcagtctgttcagtggtcagcaggccccccaccccccgccgactgccctcgccatcgtggtcagacccccctcccaacacaacacgctgctggtctgtgtcagcctttgtaacgtgggaggctctgccgtgtcttccgggtgaactgtatttggattgcgcgcattgtcacggtccgcccctgggctgcaggcgccccttcctctgggcacccctgcattctgcatccccacctctagacgctgtaataaacagactgttttcactcggaaaaaaaat

SEQ ID NO: 369438 - DNA, 5714 bp, Homo sapiens
gtaagcttgtcgagcgcgtcacagcaggcaggcctgggcccctcggctggatggtttctcagcggccctgggtgtcatggagccacactctggcaggctcgagctcaaggctcgctgcgaggagctgcagctggactgggccacgctgtcgctggagaagctgttgaaggagaagcaggccctgaagagccagatctcggagaagcagaggcactgcctggagctgcagatcagcattgtggagctagagaagagccagcggcagcaggagctcctgcagctcaagtcctgtgtgccgcctgacgacgccctgtccctgcacctgcgtgggaagggcgccctgggccgcgagctggagcctgacgccagccggctgcacctggagctggactgcaccaagttctcgctgcctcacttgagcagcatgagcccggagctctccatgaacggccaggctgctggctatgagctctgcggtgtgctgagccggccttcgtcgaagcagaacacgccccagtacctggcctcacccctggaccaggaggtggtgccctgtacccctagccacgtcggccggccgcgcctggagaagctgtctggcctagccgcacccgactacactaggctgtccccggccaagattgtgctgaggcggcacctgagccaggaccacacggtgcccggcaggccggctgccagtgagctgcattcgagagctgagcacaccaaggagaacggccttccctaccagagccccagcgtgcctggcagcatgaagctgagccctcaggacccgcggcccctgtcccctggggccttgcagcttgctggagagaagagcagtgagaagggcctgagagagcgcgcctacggcagcagcggggagctcatcaccagcctgcccatcagcatcccgctcagcaccgtgcagcccaacaagctcccggtcagcattcccctggccagcgtggtgctgcccagccgcgccgagagggcgaggagcacccccagtcccgtgctgcagccccgtgacccctcgtccacacttgaaaagcagattggtgctaatgcccacggtgctgggagcagaagccttgccctggcccccgcaggcttctcctacgctggctcggtggccatcagcggggccttggcgggcagcccggcctctctcacacctggagccgagccggccaccttggatgagtcctccagctctgggagcctttttgccaccgtggggtcccgcagctccacgccacagcaccccctgctgctggcacagccccggaactcgcttcctgcctctcccgcccaccagctctcctccagtccccggcttggtggggccgcccagggcccgttgcccgaggccagcaagggagacctgccctccgattccggcttctcagatcctgagagtgaagccaagaggaggattgtgttcaccatcaccactggtgcgggcagtgccaagcagtcgccctccagcaagcacagccccctgaccgccagcgcccgtggggactgtgtgccgagccacgggcaggacagtcgcaggcgcggccggcggaagcgagcatctgcggggacgcccagcttgagcgcaggcgtgtcccccaagcgccgagccctgccgtccgtcgctggccttttcacacagccttcggggtctcccctcaacctcaactccatggtcagtaacatcaaccagcccctggagattacagccatctcgtccccggagacctccctgaagagctcccctgtgccctaccaggaccacgaccagccccccgtgctcaagaaggagcggcctctgagccagaccaatggggcacactactccccactcacctcagacgaggagccaggctctgaggacgagcccagcagtgctcgaattgagagaaaaattgcaacaatctccttagaaagcaaatctcccccgaaaaccttggaaaatggtggtggcttggcgggaaggaagcccgcgcccgccggcgagccagtcaatagcagcaagtggaagtccaccttctcgcccatctccgacatcggcctggccaagtcggcggacagcccgctgcaggccagctccgccctcagccagaactccctgttcacgttccggcccgccctggaggagccctctgccgatgccaagctggccgctcaccccaggaaaggctttcccggctccctgtcgggggctgacggactcagcccgggcaccaaccctgccaacggctgcaccttcggcgggggcctggccgcggacctgagtttacacagcttcagtgatggtgcttctcttccccacaagggccccgaggcggccggcctgagctccccgctgagcttcccctcgcagcgcggcaaggagggctcggacgccaaccctttcctgagcaagaggcagctggacggcctggctgggctgaagggcgagggcagccgcggcaaggaggcaggggagggcggcctaccgctgtgcgggcccacggacaagaccccactgctgagcggcaaggccgccaaggcccgggaccgcgaggtcgacctcaagaatggccacaacctcttcatctctgcggcggccgtgcctcccggaagcctcctcagcggccccggcctggccccggcggcgtcctccgcaggcggcgcggcgtcctccgcccagacgcaccggtccttcctgggccccttcccgccgggaccgcagttcgcgctcggccccatgtccctgcaggccaacctcggctccgtggccggctcctccgtgctgcagtcgctgttcagctctgtgccggccgccgcaggcctggtgcacgtgtcgtccgctgccaccagactgaccaactcgcacgccatgggcagcttttccggggtggcaggcggcacagttggaggtaactaggatttctacctcaaccgcgagacctatgcaaggacggtgtggaccaactcgcgcccgcggcatggtgcccgccggcctgccgggctcccacccctggacggcagaggcaaggacggacgggagctccactgtgaatcggcggcacgcgccgcaggaggctgggactggtccagtttgtactgtcgatagttttagataaagtatttatcattttttaaaaagtataaacaattctgacttattttattccatctaagtggtaaaaggcaacttattgagaaatataaatatctatatatgagagctctatataaagacacgtgtctgcagggcgggcccgccagcggattcgccacagcctgccccggtgctatctcgtccccaggcccgcgcctgcctccacccgcttggtgctgactagacgctgacaacgccgaaccccgttctcggaaacgccgcccggccggctcccccgacgcgctgctcccgtaccaaaggcaggcccgtcgccaccacattcctcggaggcctccccgcggcctgagccccttcctgagcgccctggcgcctgccctgagctcttcacctttaccccggcactgtgaacccccagactgttcaccctccggggcgtgggttgcgcccttgcatgtgaaggggcctgcgcggtgacgcagctggccatgtgctgcgcgatggtgctgtgaggacggcgcgggcacgttgaacaagtgcatttacttttgtatttctcggctgtccatggctcgcagcatgccctgcgatgcggggcaggcctgtcgtgggtcccttggtgtttctgtacaggagagagtcacactaatgagtggcagtattttatagagatgtgatgagaatttataaatttcatagatttgacagcttttatttttagatggtataatgcacagtgaagaggaaagaaaagcgaggggaaaaaaccttatttattcaaacagtgcacaaaatggccccagcgtcagccccgaccctagacccctcagttgcagctcccagcagcccagacagagctgccggcgcccctgcctgccccacatcccttcctgtcagggccacgcctggcacccatcccttggagcctgtgctggttctcccagctgctgtgggtgtgctggggccagggtgcactgctgaaacctggcctctctggccctaggccccagggtgacgtcggccccccactctgcagccttggcgggtgcctgggactgggtgtggaaggagaggagctgaggccggggtgtagcaggcaggcagggccactccagtgcttctggagccctgagcagtcagggcctgggttgtctgagcagtggtggctctgtgccctccctggaggatgggatctgggagtctgagctccccgcatctggccctgggctgtgtggcacttgctgagcccaccttctcaagtgcttgctcctgtgagatggcatcggggagccccttccccaaggtgccacagatccaccctccagggagctgccagccctgtgttctggttcccaagggcaggatggacacacgtcacatccctaccacgtggcctccaaagggagccacggaggaaaggcttctgtggttgctaggtgggggagtcctgtgtgggagggcctgaagacccctgcttgtgcctggtgaggggggtgctgcctcccccagcccccaacaacctctcagacccccaccctccaacatagctgagttctgaagatggtgctccggacctgtcctcttaagtggtgcccagtgccctccccaccccacgttggtgctctcagctagaaggtgctgtgcctctgcctgagccccaagccccgagcctggccttcaggacaggcagcctgctctgtgtcgccacgggccggatacgccacagggttgatggcagagacggccgagtccctggtctagaacaagacacattctttaaacactgtattacttctgcctccctctaggtgacagtggcagtccgggtgccatcacgggtcctgcagatggccatgcagggctcctgcccacgcaggccaccgtatgttcaggacacgcactgggtctcagagccactggcccaggcagaagtctccttgagcccactgggtcatatgcgtgtcaccacacgtgaactagtgtggtggctgcctgcggacaccctcctgttctgagccctgggcctgtgttcttctcagacactcccagactgaggggtggtgtgtggcgggtggcagggtggctgtggagactggggatctggagcctggtgctggcacctggcctgagtttccgtgggcagctggcggggacctgtgctgctgctgctgactgtgggtgggcgggcggcgcctgggagtggctcttgctcaggaattgataggaaccctaaaaactaggataccccctcctcggcccatgaggcacgcacagtgacttatttaagacttcccccttaatttatctgcccccaggatgcgtcagtctgttcagtggtcagcaggccccccaccccccgccgactgccctcgccatcgtggtcagacccccctcccaacacaacacgctgctggtctgtgtcagcctttgtaacgtgggaggctctgccgtgtcttccgggtgaactgtatttggattgcgcgcattgtcacggtccgcccctgggctgcaggcgccccttcctctgggcacccctgcattctgcatccccacctctagacgctgtaataaacagactgttttcactcggaaaaaaaat

SEQ ID NO: 369439 - DNA, 6970 bp, Homo sapiens
gcggccgcgcgcgcggacatgggggagaagctggagctgagactgaagtcgcccgtgggggctgagcccgccgtctacccgtggccgctgccggtctacgataaacatcacgatgctgctcatgaaatcatcgagaccatccgatgggtctgtgaagaaatcccggatctcaagctcgctatggagaattacgttttaattgactatgacaccaaaagcttcgagagcatgcagaggctctgcgacaagtacaaccgtgccatcgacagcatccaccagctgtggaagggcaccacgcagcccatgaagctgaacacgcggccgtccactggactcctgcgccatatcctgcagcaggtctacaaccactcggtgaccgaccccgagaagctcaacaactacgagcccttctcccccgaggtgtacggggagacctccttcgacctggtggcccagatgattgatgagatcaagatgaccgacgacgacctgtttgtggacttggggagcggtgtgggccaggtcgtgctccaggttgctgctgccaccaactgcaaacatcactatggcgtcgagaaagcagacatcccggccaagtatgcggagaccatggaccgcgagttcaggaagtggatgaaatggtatggaaaaaagcatgcagaatacacattggagagaggcgatttcctctcagaagagtggagggagcgaatcgccaacacgagtgttatatttgtgaataattttgcctttggtcctgaggtggatcaccagctgaaggagcggtttgcaaacatgaaggaaggtggcagaatcgtgtcctcgaaaccctttgcacctctgaacttcagaataaacagtagaaacttgagtgacatcggcaccatcatgcgcgtggtggagctctcgcccctgaagggctcggtgtcgtggacggggaagccagtctcctactacctgcacactatcgaccgcaccatacttgaaaactatttttctagtctgaaaaacccaaaactcagggaggaacaggaggcagcccggcgccgccagcagcgcgagagcaagagcaacgcggcacgcccactaagggcccagagggcaaggtggccggccccgccgacgcccccatggactctggtgctgaggaagagaaggcgggagcagccaccgtgaagaagccgtctccctccaaagcccgcaagaagaagctaaacaagaaggggaggaagatggctggccgcaagcgcgggcgccccaagaagatgaacactgcgaaccccgagcggaagcccaagaagaaccaaagtgcagcggcactcccccaacccgctgctggtggcgcccaccccgcccgcgctgcagaagcttctagagtccttcaagatccagtacctgcagttcctggcatacacaaagaccccccagtacaaggccagcctgcaggagctgctgggccaggagaaggagaagaacgcccagctcctgggtgcggctcagcagctcctcagccactgccaggcccagaaggaggagatcaggaggctgtttcagcaaaaattggatgagctgggtgtgaaggcgctgacctacaacgacctgattcaagcgcagaaggagatctccgcccataaccagcagctgcgggagcagtcggagcagctggagcaggacaaccgcgcgctccgcggccagagcttgcagctgctcaaggctcgctgcgaggagctgcagctggactgggccacgctgtcgctggagaagctgttgaaggagaagcaggccctgaagagccagatctcggagaagcagaggcactgcctggagctgcagatcagcattgtggagctagagaagagccagcggcagcaggagctcctgcagctcaagtcctgtgtgccgcctgacgacgccctgtccctgcacctgcgtgggaagggcgccctgggccgcgagctggagcctgacgccagccggctgcacctggagctggactgcaccaagttctcgctgcctcacttgagcagcatgagcccggagctctccatgaacggccaggctgctggctatgagctctgcggtgtgctgagccggccttcgtcgaagcagaacacgccccagtacctggcctcacccctggaccaggaggtggtgccctgtacccctagccacgtcggccggccgcgcctggagaagctgtctggcctagccgcacccgactacactaggctgtccccggccaagattgtgctgaggcggcacctgagccaggaccacacggtgcccggcaggccggctgccagtgagctgcattcgagagctgagcacaccaaggagaacggccttccctaccagagccccagcgtgcctggcagcatgaagctgagccctcaggacccgcggcccctgtcccctggggccttgcagcttgctggagagaagagcagtgagaagggcctgagagagcgcgcctacggcagcagcggggagctcatcaccagcctgcccatcagcatcccgctcagcaccgtgcagcccaacaagctcccggtcagcattcccctggccagcgtggtgctgcccagccgcgccgagagggcgaggagcacccccagtcccgtgctgcagccccgtgacccctcgtccacacttgaaaagcagattggtgctaatgcccacggtgctgggagcagaagccttgccctggcccccgcaggcttctcctacgctggctcggtggccatcagcggggccttggcgggcagcccggcctctctcacacctggagccgagccggccaccttggatgagtcctccagctctgggagcctttttgccaccgtggggtcccgcagctccacgccacagcaccccctgctgctggcacagccccggaactcgcttcctgcctctcccgcccaccagctctcctccagtccccggcttggtggggccgcccagggcccgttgcccgaggccagcaagggagacctgccctccgattccggcttctcagatcctgagagtgaagccaagaggaggattgtgttcaccatcaccactggtgcgggcagtgccaagcagtcgccctccagcaagcacagccccctgaccgccagcgcccgtggggactgtgtgccgagccacgggcaggacagtcgcaggcgcggccggcggaagcgagcatctgcggggacgcccagcttgagcgcaggcgtgtcccccaagcgccgagccctgccgtccgtcgctggccttttcacacagccttcggggtctcccctcaacctcaactccatggtcagtaacatcaaccagcccctggagattacagccatctcgtccccggagacctccctgaagagctcccctgtgccctaccaggaccacgaccagccccccgtgctcaagaaggagcggcctctgagccagaccaatggggcacactactccccactcacctcagacgaggagccaggctctgaggacgagcccagcagtgctcgaattgagagaaaaattgcaacaatctccttagaaagcaaatctcccccgaaaaccttggaaaatggtggtggcttggcgggaaggaagcccgcgcccgccggcgagccagtcaatagcagcaagtggaagtccaccttctcgcccatctccgacatcggcctggccaagtcggcggacagcccgctgcaggccagctccgccctcagccagaactccctgttcacgttccggcccgccctggaggagccctctgccgatgccaagctggccgctcaccccaggaaaggctttcccggctccctgtcgggggctgacggactcagcccgggcaccaaccctgccaacggctgcaccttcggcgggggcctggccgcggacctgagtttacacagcttcagtgatggtgcttctcttccccacaagggccccgaggcggccggcctgagctccccgctgagcttcccctcgcagcgcggcaaggagggctcggacgccaaccctttcctgagcaagaggcagctggacggcctggctgggctgaagggcgagggcagccgcggcaaggaggcaggggagggcggcctaccgctgtgcgggcccacggacaagaccccactgctgagcggcaaggccgccaaggcccgggaccgcgaggtcgacctcaagaatggccacaacctcttcatctctgcggcggccgtgcctcccggaagcctcctcagcggccccggcctggccccggcggcgtcctccgcaggcggcgcggcgtcctccgcccagacgcaccggtccttcctgggccccttcccgccgggaccgcagttcgcgctcggccccatgtccctgcaggccaacctcggctccgtggccggctcctccgtgctgcagtcgctgttcagctctgtgccggccgccgcaggcctggtgcacgtgtcgtccgctgccaccagactgaccaactcgcacgccatgggcagcttttccggggtggcaggcggcacagttggaggtaactaggatttctacctcaaccgcgagacctatgcaaggacggtgtggaccaactcgcgcccgcggcatggtgcccgccggcctgccgggctcccacccctggacggcagaggcaaggacggacgggagctccactgtgaatcggcggcacgcgccgcaggaggctgggactggtccagtttgtactgtcgatagttttagataaagtatttatcattttttaaaaagtataaacaattctgacttattttattccatctaagtggtaaaaggcaacttattgagaaatataaatatctatatatgagagctctatataaagacacgtgtctgcagggcgggcccgccagcggattcgccacagcctgccccggtgctatctcgtccccaggcccgcgcctgcctccacccgcttggtgctgactagacgctgacaacgccgaaccccgttctcggaaacgccgcccggccggctcccccgacgcgctgctcccgtaccaaaggcaggcccgtcgccaccacattcctcggaggcctccccgcggcctgagccccttcctgagcgccctggcgcctgccctgagctcttcacctttaccccggcactgtgaacccccagactgttcaccctccggggcgtgggttgcgcccttgcatgtgaaggggcctgcgcggtgacgcagctggccatgtgctgcgcgatggtgctgtgaggacggcgcgggcacgttgaacaagtgcatttacttttgtatttctcggctgtccatggctcgcagcatgccctgcgatgcggggcaggcctgtcgtgggtcccttggtgtttctgtacaggagagagtcacactaatgagtggcagtattttatagagatgtgatgagaatttataaatttcatagatttgacagcttttatttttagatggtataatgcacagtgaagaggaaagaaaagcgaggggaaaaaaccttatttattcaaacagtgcacaaaatggccccagcgtcagccccgaccctagacccctcagttgcagctcccagcagcccagacagagctgccggcgcccctgcctgccccacatcccttcctgtcagggccacgcctggcacccatcccttggagcctgtgctggttctcccagctgctgtgggtgtgctggggccagggtgcactgctgaaacctggcctctctggccctaggccccagggtgacgtcggccccccactctgcagccttggcgggtgcctgggactgggtgtggaaggagaggagctgaggccggggtgtagcaggcaggcagggccactccagtgcttctggagccctgagcagtcagggcctgggttgtctgagcagtggtggctctgtgccctccctggaggatgggatctgggagtctgagctccccgcatctggccctgggctgtgtggcacttgctgagcccaccttctcaagtgcttgctcctgtgagatggcatcggggagccccttccccaaggtgccacagatccaccctccagggagctgccagccctgtgttctggttcccaagggcaggatggacacacgtcacatccctaccacgtggcctccaaagggagccacggaggaaaggcttctgtggttgctaggtgggggagtcctgtgtgggagggcctgaagacccctgcttgtgcctggtgaggggggtgctgcctcccccagcccccaacaacctctcagacccccaccctccaacatagctgagttctgaagatggtgctccggacctgtcctcttaagtggtgcccagtgccctccccaccccacgttggtgctctcagctagaaggtgctgtgcctctgcctgagccccaagccccgagcctggccttcaggacaggcagcctgctctgtgtcgccacgggccggatacgccacagggttgatggcagagacggccgagtccctggtctagaacaagacacattctttaaacactgtattacttctgcctccctctaggtgacagtggcagtccgggtgccatcacgggtcctgcagatggccatgcagggctcctgcccacgcaggccaccgtatgttcaggacacgcactgggtctcagagccactggcccaggcagaagtctccttgagcccactgggtcatatgcgtgtcaccacacgtgaactagtgtggtggctgcctgcggacaccctcctgttctgagccctgggcctgtgttcttctcagacacctcccaacacaacacgctgctggtctgtgtcagcctttgtaacgtgggaggctctgccgtgtcttccgggtgaactgtatttggattgcgcgcattgtcacggtccgcccctgggctgcaggcgccccttcctctgggcacccctgcattctgcatccccacctctagacgctgtaataaacagactgttttcactcggaaaaaaaat

SEQ ID NO: 369440 - DNA, 4754 bp, Homo sapiens
gcggccgcgcgcgcggacatgggggagaagctggagctgagactgaagtcgcccgtgggggctgagcccgccgtctacccgtggccgctgccggtctacgataaacatcacgatgctgctcatgaaatcatcgagaccatccgatgggtctgtgaagaaatcccggatctcaagctcgctatggagaattacgttttaattgactatgacaccaaaagcttcgagagcatgcagaggctctgcgacaagtacaaccgtgccatcgacagcatccaccagctgtggaagggcaccacgcagcccatgaagctgaacacgcggccgtccactggactcctgcgccatatcctgcagcaggtctacaaccactcggtgaccgaccccgagaagctcaacaactacgagcccttctcccccgaggtgtacggggagacctccttcgacctggtggcccagatgattgatgagatcaagatgaccgacgacgacctgtttgtggacttggggagcggtgtgggccaggtcgtgctccaggttgctgctgccaccaactgcaaacatcactatggcgtcgagaaagcagacatcccggccaagtatgcggagaccatggaccgcgagttcaggaagtggatgaaatggtatggaaaaaagcatgcagaatacacattggagagaggcgatttcctctcagaagagtggagggagcgaatcgccaacacgagtgttatatttgtgaataattttgcctttggtcctgaggtggatcaccagctgaaggagcggtttgcaaacatgaaggaaggtggcagaatcgtgtcctcgaaaccctttgcacctctgaacttcagaataaacagtagaaacttgagtgacatcggcaccatcatgcgcgtggtggagctctcgcccctgaagggctcggtgtcgtggacggggaagccagtctcctactacctgcacactatcgaccgcaccatacttgaaaactatttttctagtctgaaaaacccaaaactcagggaggaacaggaggcagcccggcgccgccagcagcgcgagagcaagagcaacgcggcacgcccactaagggcccagagggcaaggtggccggccccgccgacgcccccatggactctggtgctgaggaagagaaggcgggagcagccaccgtgaagaagccgtctccctccaaagcccgcaagaagaagctaaacaagaaggggaggaagatggctggccgcaagcgcgggcgccccaagaagatgaacactgcgaaccccgagcggaagcccaagaagaaccaaagtgcagcggcactcccccaacccgctgctggtggcgcccaccccgcccgcgctgcagaagcttctagagtccttcaagatccagtacctgcagttcctggcatacacaaagaccccccagtacaaggccagcctgcaggagctgctgggccaggagaaggagaagaacgcccagctcctgggtgcggctcagcagctcctcagccactgccaggcccagaaggaggagatcaggaggctgtttcagcaaaaattggatgagctgggtgtgaaggcgctgacctacaacgacctgattcaagcgcagaaggagatctccgcccataaccagcagctgcgggagcagtcggagcagctggagcaggacaaccgcgcgctccgcggccagagcttgcagctgctcaaggctcgctgcgaggagctgcagctggactgggccacgctgtcgctggagaagctgttgaaggagaagcaggccctgaagagccagatctcggagaagcagaggcactgcctggagctgcagatcagcattgtggagctagagaagagccagcggcagcaggagctcctgcagctcaagtcctgtgtgccgcctgacgacgccctgtccctgcacctgcgtgggaagggcgccctgggccgcgagctggagcctgacgccagccggctgcacctggagctggactgcaccaagttctcgctgcctcacttgagcagcatgagcccggagctctccatgaacggccaggctgctggctatgagctctgcggtgtgctgagccggccttcgtcgaagcagaacacgccccagtacctggcctcacccctggaccaggaggtggtgccctgtacccctagccacgtcggccggccgcgcctggagaagctgtctggcctagccgcacccgactacactaggctgtccccggccaagattgtgctgaggcggcacctgagccaggaccacacggtgcccggcaggccggctgccagtgagctgcattcgagagctgagcacaccaaggagaacggccttccctaccagagccccagcgtgcctggcagcatgaagctgagccctcaggacccgcggcccctgtcccctggggccttgcagcttgctggagagaagagcagtgagaagggcctgagagagcgcgcctacggcagcagcggggagctcatcaccagcctgcccatcagcatcccgctcagcaccgtgcagcccaacaagctcccggtcagcattcccctggccagcgtggtgctgcccagccgcgccgagagggcgaggagcacccccagtcccgtgctgcagccccgtgacccctcgtccacacttgaaaagcagattggtgctaatgcccacggtgctgggagcagaagccttgccctggcccccgcaggcttctcctacgctggctcggtggccatcagcggggccttggcgggcagcccggcctctctcacacctggagccgagccggccaccttggatgagtcctccagctctgggagcctttttgccaccgtggggtcccgcagctccacgccacagcaccccctgctgctggcacagccccggaactcgcttcctgcctctcccgcccaccagctctcctccagtccccggcttggtggggccgcccagggcccgttgcccgaggccagcaagggagacctgccctccgattccggcttctcagatcctgagagtgaagccaagaggaggattgtgttcaccatcaccactggtgcgggcagtgccaagcagtcgccctccagcaagcacagccccctgaccgccagcgcccgtggggactgtgtgccgagccacgggcaggacagtcgcaggcgcggccggcggaagcgagcatctgcggggacgcccagcttgagcgcaggcgtgtcccccaagcgccgagccctgccgtccgtcgctggccttttcacacagccttcggggtctcccctcaacctcaactccatggtcagtaacatcaaccagcccctggagattacagccatctcgtccccggagacctccctgaagagctcccctgtgccctaccaggaccacgaccagccccccgtgctcaagaaggagcggcctctgagccagaccaatggggcacactactccccactcacctcagacgaggagccaggctctgaggacgagcccagcagtgctcgaattgagagaaaaattgcaacaatctccttagaaagcaaatctcccccgaaaaccttggaaaatggtggtggcttggcgggaaggaagcccgcgcccgccggcgagccagtcaatagcagcaagtggaagtccaccttctcgcccatctccgacatcggcctggccaagtcggcggacagcccgctgcaggccagctccgccctcagccagaactccctgttcacgttccggcccgccctggaggagccctctgccgatgccaagctggccgctcaccccaggaaaggctttcccggctccctgtcgggggctgacggactcagcccgggcaccaaccctgccaacggctgcaccttcggcgggggcctggccgcggacctgagtttacacagcttcagtgatggtgcttctcttccccacaagggccccgaggcggccggcctgagctccccgctgagcttcccctcgcagcgcggcaaggagggctcggacgccaaccctttcctgagcaagaggcagctggacggcctggctgggctgaagggcgagggcagccgcggcaaggaggcaggggagggcggcctaccgctgtgcgggcccacggacaagaccccactgctgagcggcaaggccgccaaggcccgggaccgcgaggtcgacctcaagaatggccacaacctcttcatctctgcggcggccgtgcctcccggaagcctcctcagcggccccggcctggccccggcggcgtcctccgcaggcggcgcggcgtcctccgcccagacgcaccggtccttcctgggccccttcccgccgggaccgcagttcgcgctcggccccatgtccctgcaggccaacctcggctccgtggccggctcctccgtgctgcagtcgctgttcagctctgtgccggccgccgcaggcctggtgcacgtgtcgtccgctgccaccagactgaccaactcgcacgccatgggcagcttttccggggtggcaggcggcacagttggaggtaactaggatttctacctcaaccgcgagacctatgcaaggacggtgtggaccaactcgcgcccgcggcatggtgcccgccggcctgccgggctcccacccctggacggcagaggcaaggacggacgggagctccactgtgaatcggcggcacgcgccgcaggaggctgggactggtccagtttgtactgtcgatagttttagataaagtatttatcattttttaaaaagtataaaca

SEQ ID NO: 369441 - DNA, 3544 bp, Homo sapiens
gcggccgcgcgcgcggacatgggggagaagctggagctgagactgaagtcgcccgtgggggctgagcccgccgtctacccgtggccgctgccggtctacgataaacatcacgatgctgctcatgaaatcatcgagaccatccgatgggtctgtgaagaaatcccggatctcaagctcgctatggagaattacgttttaattgactatgacaccaaaagcttcgagagcatgcagaggctctgcgacaagtacaaccgtgccatcgacagcatccaccagctgtggaagggcaccacgcagcccatgaagctgaacacgcggccgtccactggactcctgcgccatatcctgcagcaggtctacaaccactcggtgaccgaccccgagaagctcaacaactacgagcccttctcccccgaggtgtacggggagacctccttcgacctggtggcccagatgattgatgagatcaagatgaccgacgacgacctgtttgtggacttggggagcggtgtgggccaggtcgtgctccaggttgctgctgccaccaactgcaaacatcactatggcgtcgagaaagcagacatcccggccaagtatgcggagaccatggaccgcgagttcaggaagtggatgaaatggtatggaaaaaagcatgcagaatacacattggagagaggcgatttcctctcagaagagtggagggagcgaatcgccaacacgagtgttatatttgtgaataattttgcctttggtcctgaggtggatcaccagctgaaggagcggtttgcaaacatgaaggaaggtggcagaatcgtgtcctcgaaaccctttgcacctctgaacttcagaataaacagtagaaacttgagtgacatcggcaccatcatgcgcgtggtggagctctcgcccctgaagggctcggtgtcgtggacggggaagccagtctcctactacctgcacactatcgaccgcaccatacttgaaaactatttttctagtctgaaaaacccaaaactcagggaggaacaggaggcagcccggcgccgccagcagcgcgagagcaagagcaacgcggcacgcccactaagggcccagagggcaaggtggccggccccgccgacgcccccatggactctggtgctgaggaagagaaggcgggagcagccaccgtgaagaagccgtctccctccaaagcccgcaagaagaagctaaacaagaaggggaggaagatggctggccgcaagcgcgggcgccccaagaagatgaacactgcgaaccccgagcggaagcccaagaagaaccaaagtgcagcggcactcccccaacccgctgctggtggcgcccaccccgcccgcgctgcagaagcttctagagtccttcaagatccagtacctgcagttcctggcatacacaaagaccccccagtacaaggccagcctgcaggagctgctgggccaggagaaggagaagaacgcccagctcctgggtgcggctcagcagctcctcagccactgccaggcccagaaggaggagatcaggaggctgtttcagcaaaaattggatgagctgggtgtgaaggcgctgacctacaacgacctgattcaagcgcagaaggagatctccgcccataaccagcagctgcgggagcagtcggagcagctggagcaggacaaccgcgcgctccgcggccagagcttgcagctgctcaaggctcgctgcgaggagctgcagctggactgggccacgctgtcgctggagaagctgttgaaggagaagcaggccctgaagagccagatctcggagaagcagaggcactgcctggagctgcagatcagcattgtggagctagagaagagccagcggcagcaggagctcctgcagctcaagtcctgtgtgccgcctgacgacgccctgtccctgcacctgcgtgggaagggcgccctgggccgcgagctggagcctgacgccagccggctgcacctggagctggactgcaccaagttctcgctgcctcacttgagcagcatgagcccggagctctccatgaacggccaggctgctggctatgagctctgcggtgtgctgagccggccttcgtcgaagcagaacacgccccagtacctggcctcacccctggaccaggaggtggtgccctgtacccctagccacgtcggccggccgcgcctggagaagctgtctggcctagccgcacccgactacactaggctgtccccggccaagattgtgctgaggcggcacctgagccaggaccacacggtgcccggcaggccggctgccagtgagctgcattcgagagctgagcacaccaaggagaacggccttccctaccagagccccagcgtgcctggcagcatgaagctgagccctcaggacccgcggcccctgtcccctggggccttgcagcttgctggagagaagagcagtgagaagggcctgagagagcgcgcctacggcagcagcggggagctcatcaccagcctgcccatcagcatcccgctcagcaccgtgcagcccaacaagctcccggtcagcattcccctggccagcgtggtgctgcccagccgcgccgagagggcgaggagcacccccagtcccgtgctgcagccccgtgacccctcgtccacacttgaaaagcagattggtgctaatgcccacggtgctgggagcagaagccttgccctggcccccgcaggcttctcctacgctggctcggtggccatcagcggggccttggcgggcagcccggcctctctcacacctggagccgagccggccaccttggatgagtcctccagctctgggagcctttttgccaccgtggggtcccgcagctccacgccacagcaccccctgctgctggcacagccccggaactcgcttcctgcctctcccgcccaccagctctcctccagtccccggcttggtggggccgcccagggcccgttgcccgaggccagcaagggagacctgccctccgattccggcttctcagatcctgagagtgaagccaagaggaggattgtgttcaccatcaccactggtgcgggcagtgccaagcagtcgccctccagcaagcacagccccctgaccgccagcgcccgtggggactgtgtgccgagccacgggcaggacagtcgcaggcgcggccggcggaagcgagcatctgcggggacgcccagcttgagcgcaggcgtgtcccccgtgctcaagaaggagcggcctctgagccagaccaatggggcacactactccccactcaactccatggtcagtaacatcaaccagcccctggagattacagccatctcgtccccggagacctccctgaagagctcccctgtgccctaccaggaccactgtgaatcggcggcacgcgccgcaggaggctgggactggtccagtttgtactgtcgatagttttagataaagtatttatcattttttaaaaagtataaacacattataaatttttatttttataaaaaaaattgaccggtcgaaactttattccttttatgag

SEQ ID NO: 369442 - DNA, 1986 bp, Homo sapiens
gcggccgcgcgcgcggacatgggggagaagctggagctgagactgaagtcgcccgtgggggctgagcccgccgtctacccgtggccgctgccggtctacgataaacatcacgatgctgctcatgaaatcatcgagaccatccgatgggtctgtgaagaaatcccggatctcaagctcgctatggagaattacgttttaattgactatgacaccaaaagcttcgagagcatgcagaggctctgcgacaagtacaaccgtgccatcgacagcatccaccagctgtggaagggcaccacgcagcccatgaagctgaacacgcggccgtccactggactcctgcgccatatcctgcagcaggtctacaaccactcggtgaccgaccccgagaagctcaacaactacgagcccttctcccccgaggtgtacggggagacctccttcgacctggtggcccagatgattgatgagatcaagatgaccgacgacgacctgtttgtggacttggggagcggtgtgggccaggtcgtgctccaggttgctgctgccaccaactgcaaacatcactatggcgtcgagaaagcagacatcccggccaagtatgcggagaccatggaccgcgagttcaggaagtggatgaaatggtatggaaaaaagcatgcagaatacacattggagagaggcgatttcctctcagaagagtggagggagcgaatcgccaacacgagtgttatatttgtgaataattttgcctttggtcctgaggtggatcaccagctgaaggagcggtttgcaaacatgaaggaaggtggcagaatcgtgtcctcgaaaccctttgcacctctgaacttcagaataaacagtagaaacttgagtgacatcggcaccatcatgcgcgtggtggagctctcgcccctgaagggctcggtgtcgtggacggggaagccagtctcctactacctgcacactatcgaccgcaccatacttgaaaactatttttctagtctgaaaaacccaaaactcagggaggaacaggaggcagcccggcgccgccagcagcgcgagagcaagagcaacgcggcacgcccactaagggcccagagggcaaggtggccggccccgccgacgcccccatggactctggtgctgaggaagagaaggcgggagcagccaccgtgaagaagccgtctccctccaaagcccgcaagaagaagctaaacaagaaggggaggaagatggctggccgcaagcgcgggcgccccaagaagatgaacactgcgaaccccgagcggaagcccaagaagaaccaaagtgcagcggcactcccccaacccgctgctggtggcgcccaccccgcccgcgctgcagaagcttctagagtccttcaagatccagtacctgcagttcctggcatacacaaagaccccccagtacaaggccagcctgcaggagctgctgggccaggagaaggagaagaacgcccagctcctgggtgcggctcagcagctcctcagccactgccaggcccagaaggaggagatcaggaggctgtttcagcaaaaattggatgagctgggtgtgaaggcgctgacctacaacgacctgattcaagcgcagaaggagatctccgcccataaccagcagctgcgggagcagtcggagcagctggagcaggacaaccgcgcgctccgcggccagagcttgcagctgctcaaggctcgctgcgaggagctgcagctggactgggccacgctgtcgctggagaagctgttgaaggagaagcaggccctgaagagccagatctcggagaagcagaggcactgcctggagctgcaggtgggctgcgcgcgaggctgcactccgtggtgtccgagcctctcccatcagcctccctgtgacgtcgttgagcctagggtggttgcggttgcagcagcctaggaagaaggtggaggaggacagttgggtggaggcttatggaaccttctgtct

SEQ ID NO: 369443 - DNA, 384 bp, Homo sapiens
tgaagcaaaaggggaataaccatagtattgagctcatagggttgtaggggaaatgaagtgatattgtccatgtaaagtaacttagggcaatgcatggcccatggtaagtgactaatacattactgtagtaggtataagatggtgatgggattccttaagaaaaattccataaaattgacaaaattagggcgctgttcttagttagctgctgtgtgtgtgtgtggtttgtatgtgtgtgttgtgggtggggggtgacagaagattactatagccagcatcagtttatcaagcatgaatttaaagaatgaattgaaagaaacaattcgtccagcttttatgtgccaggtactgtagtaagcatgttagatacacattgtatttagt

SEQ ID NO: 369444 - DNA, 2200 bp, Homo sapiens
gatagataatagtgtaaaatggacttgccttgcttctactgatgtttttcacatgtttcccgtaactgatacttttcatcagttgtggaattcccataattgcagggattccttttctgtccttaggatcccctgaaggccttttaatcttgttcaccaaatgtgtgttccttgctgacacaaaatggtctctaccatcagtggtggtactcttttttccccctttgttcaattcaatctcaggaacgtatttcctacattaataaatatttactgagcacctaccaaatgccaagcactttcctagaacaaaagttcttttgaaacaaaaaagtatcttggcagttaaggcaaaatgacctaaagaagttttaaaatgaaaggtctcctatatttcagggtctttgagatgaaaccctgcaagtagacttacgtgaatgatttttgctgtggtaagtatacaaatgcagtgggagttgccagactttaaaagacgtgaataacaatcatataaaatgccagacattgttgtggaaaagagaaagaagataccctactagggggtttttacctcctttaagaaacagactaaaactagttttctcaagtgcctgaatatatatggtttaaataacaatatacaacactttcaaaataaaatctaggaatgtttacatatgcttttaatctcaaagtctaatgtcttgagaaaagtaaatctgtgagatcactgactcacagaattttagcaaatagaaaaaatccagtatcttcagaacacaagggctgatcttttgtcccctacccgcaagacattgcttggtaccaaaatagaaagttatttttttaagggggaattatgggttttttctgagaacagataatatgaaaatagttaatagtattggtatgaccacatattttcctaattcaaaataaggacgctatgctctacaagagtattttaaaacaataatgagataatgtttgaaatagaaacaaaatatttgtgagtatttctggagtatctggctggtccatatcaactggaatacagataacccaggtgtagatttctttgctcttagagggtgaaaaaagctttttgttgttttattttcagttatattggttttaattatccagcctccagcaaaattaaatacatatggattcaaagctgatagctaccatagtttgccaaaatacaaccagatgttttcaaaatgtggaaaaattgtttttggactctacaggaatagaacccttcccccaacactgggaaaaggttgttttctaggcattttcagtgttactgatatcccaggaactgtcagatcaccacccggcacatttttcatttttatctgcacttgtcttacatgcgaaatattttcttaattcatgtctcttttttgtagcatctttttttcccaagtaaataccaaaaaaaaaaaagcccaaaatacattttttaaagctaacttaaaactgaatattgtattctagtaaaactaatcaagggaaaagctttgagtaacaatatatttcacaattttgcatttagacacatttacagtgaagaaatataattaaaaacaaaaccttctatcaatccagaaattctctccacaaaggtagtaacgaaagaaacactttcattattgactaagcattaaaccagaatgtgacgcatatcacaggcaatccactaagagactgcaaagactctcgccactatgtaaccaggcagataccacccattacaggaatctcatccctgtgtagccaagcagataccacccattacatatacgttttcaggacaagcaataacgaatccttaaggaagaagatttgacaacaccttttgtcacacataattcatcctaactttacctggtaaatggagtgaccatctgtgttagcttattggccttattcagagaaaaataaatttctgtcttcatgacaggaggtagttttgcaactggaagcaagatctcaccaaagttaggaccccaccttcccaccagagctgggagatgtccttggaaaatacattcttgcatcataaaggtgacaaaaagcctatctagtcttcaaaaggatttaaagacatttcaaagagaggagaaagtacttatagttaaaagttttctaaagtaaaagctctgagaaaaagaaaggaaaagaaatc

SEQ ID NO: 369445 - DNA, 2235 bp, Homo sapiens
ggaaaatttcagcagctggggccatgtaatttaaaacctctgaaaagtgtgctgcggtccgtgcacagcattagtataacgtgagggctgaatgcagcccattctctggagaacttcctcacacaccgcagcaaagagaagactgaaagacaaacctgggtgcagccagagaggtccagatagatgagcttgtggcatccattccccaagttcagcctagggactccacgtaccccagctgggtctcattgttccagaactgcattagttaagattacccagacttggatttcaaaggaatactttcattgttccgtctgtaacacgaagtaattggggccagctggatgtcaggatgcgtgtggttaccattgtaatcttgctctgcttttgcaaagcggctgagctgcgcaaagcaagcccaggcagtgtgagaagccgagtgaatcatggccgggcgggtggaggccggagaggctccaacccggtcaaacgctacgcaccaggcctcccgtgtgacgtgtacacatatctccatgagaaatacttagattgtcaagaaagaaaattagtttatgtgctgcctggttggcctcaggatttgctgcacatgctgctagcaagaaacaagatccgcacattgaagaacaacatgttttccaagtttaaaaagctgaaaagcctggatctgcagcagaatgagatctctaaaattgagagtgaggcgttctttggtttaaacaaactcaccaccctcttactgcagcacaaccagatcaaagtcttgacggaggaagtgttcatttacacacctctcttgagctacctgcgtctttatgacaacccctggcactgtacttgtgagatagaaacgcttatttcaatgttgcagattcccaggaaccggaatttggggaactacgccaagtgtgaaagtccacaagaacaaaaaaataaaaaactgcggcagataaaatctgaacagttgtgtaatgaagaagaaaaggaacaattggacccgaaaccccaagtgtcagggagacccccagtcatcaagcctgaggtggactcaactttttgccacaattatgtgtttcccatacaaacactggactgcaaaaggaaagagttgaaaaaagtgccaaacaacatccctccagatattgttaaacttgacttgtcatacaataaaatcaaccaacttcgacccaaggaatttgaagatgttcatgagctgaagaaattaaacctcagcagcaatggcattgaattcatcgatcctgggtctttgagatgaaaccctgcaagtagacttacgtgaatgatttttgctgtgccgcttttttagggctcacacatttagaagaattagatttatcaaacaacagtctgcaaaactttgactatggcgtattagaagacttgtattttttgaaactcttgtggctcagagataacccttggagatgtgactacaacattcactacctctactactggttaaagcaccactacaatgtccattttaatggcctggaatgcaaaacgcctgaagaatacaaaggatggtctgtgggaaaatatattagaagttactatgaagaatgccccaaagacaagttaccagcatatcctgagtcatttgaccaagacacagaagatgatgaatgggaaaaaaaacatagagatcacaccgcaaagaagcaaagcgtaataattactatagtaggataaggtagaaattgttctgattgtaattagttttgtattttctatactggtgttagaaaacatatgtttacatttgattaactgtgttgcctatttatgcagggtaatccagctaaaggaagctttctttaattataagtattattgtgactattatagtaatcaagagaatgctatcatcctgcttgcctgtccatttgtggaacagcatctggtgatatgcaattccacactggtaacctgcagcagttgggtcctaatgatggcattagactttcataatgtcctgtataaatgtttttactgcttttagaaaataaagaaaaaaaacttggttcatgtttacatgcctttcgatagctgtttgtgcatacttaaagatgatcaaaatgattttatacaaatgctgttataataaaatgtcattccctacccctctactttttttcagtaagtcatcttatacattaaataaatttccatttctgatttctgtgcattcca

SEQ ID NO: 369446 - DNA, 2182 bp, Homo sapiens
ggaaaatttcagcagctggggccatgtaatttaaaacctctgaaaagtgtgctgcggtccgtgcacagcattagtataacgtgagggctgaatgcagcccattctctggagaacttcctcacacaccgcagcaaagagaagactgaaagacaaacctgggtgcagccagagaggtccagatagatgagcttgtggcatccattccccaagttcagcctagggactccacgtaccccagctgggtctcattgttccagaactgcattagttaagattacccagacttggatttcaaaggaatactttcattgttccgtctgtaacacgaagtaattggggccagctggatgtcaggatgcgtgtggttaccattgtaatcttgctctgcttttgcaaagcggctgagctgcgcaaagcaagcccaggcagtgtgagaagccgagtgaatcatggccgggcgggtggaggccggagaggctccaacccggtcaaacgctacgcaccaggcctcccgtgtgacgtgtacacatatctccatgagaaatacttagattgtcaagaaagaaaattagtttatgtgctgcctggttggcctcaggatttgctgcacatgctgctagcaagaaacaagatccgcacattgaagaacaacatgttttccaagtttaaaaagctgaaaagcctggatctgcagcagaatgagatctctaaaattgagagtgaggcgttctttggtttaaacaaactcaccaccctcttactgcagcacaaccagatcaaagtcttgacggaggaagtgttcatttacacacctctcttgagctacctgcgtctttatgacaacccctggcactgtacttgtgagatagaaacgcttatttcaatgttgcagattcccaggaaccggaatttggggaactacgccaagtgtgaaagtccacaagaacaaaaaaataaaaaactgcggcagataaaatctgaacagttgtgtaatgaagaagaaaaggaacaattggacccgaaaccccaagtgtcagggagacccccagtcatcaagcctgaggtggactcaactttttgccacaattatgtgtttcccatacaaacactggactgcaaaaggaaagagttgaaaaaagtgccaaacaacatccctccagatattgttaaacttgacttgtcatacaataaaatcaaccaacttcgacccaaggaatttgaagatgttcatgagctgaagaaattaaacctcagcagcaatggcattgaattcatcgatcctgccgcttttttagggctcacacatttagaagaattagatttatcaaacaacagtctgcaaaactttgactatggcgtattagaagacttgtattttttgaaactcttgtggctcagagataacccttggagatgtgactacaacattcactacctctactactggttaaagcaccactacaatgtccattttaatggcctggaatgcaaaacgcctgaagaatacaaaggatggtctgtgggaaaatatattagaagttactatgaagaatgccccaaagacaagttaccagcatatcctgagtcatttgaccaagacacagaagatgatgaatgggaaaaaaaacatagagatcacaccgcaaagaagcaaagcgtaataattactatagtaggataaggtagaaattgttctgattgtaattagttttgtattttctatactggtgttagaaaacatatgtttacatttgattaactgtgttgcctatttatgcagggtaatccagctaaaggaagctttctttaattataagtattattgtgactattatagtaatcaagagaatgctatcatcctgcttgcctgtccatttgtggaacagcatctggtgatatgcaattccacactggtaacctgcagcagttgggtcctaatgatggcattagactttcataatgtcctgtataaatgtttttactgcttttagaaaataaagaaaaaaaacttggttcatgtttacatgcctttcgatagctgtttgtgcatacttaaagatgatcaaaatgattttatacaaatgctgttataataaaatgtcattccctacccctctactttttttcagtaagtcatcttatacattaaataaatttccatttctgatttctgtgcattcca

SEQ ID NO: 369447 - DNA, 2030 bp, Homo sapiens
ggaaaatttcagcagctggggccatgtaatttaaaacctctgaaaagtgtgctgcggtccgtgcacagcattagtataacgtgagggctgaatgcagcccattctctggagaacttcctcacacaccgcagcaaagagaagactgaaagacaaacctgggtgcagccagagaggtccagatagatgagcttgtggcatccattccccaagttcagcctagggactccacgtaccccagctgggtctcattgttccagaactgcattagttaagattacccagacttggatttcaaaggaatactttcattgttccgtctgtaacacgaagtaattggggccagctggatgtcaggcctcccgtgtgacgtgtacacatatctccatgagaaatacttagattgtcaagaaagaaaattagtttatgtgctgcctggttggcctcaggatttgctgcacatgctgctagcaagaaacaagatccgcacattgaagaacaacatgttttccaagtttaaaaagctgaaaagcctggatctgcagcagaatgagatctctaaaattgagagtgaggcgttctttggtttaaacaaactcaccaccctcttactgcagcacaaccagatcaaagtcttgacggaggaagtgttcatttacacacctctcttgagctacctgcgtctttatgacaacccctggcactgtacttgtgagatagaaacgcttatttcaatgttgcagattcccaggaaccggaatttggggaactacgccaagtgtgaaagtccacaagaacaaaaaaataaaaaactgcggcagataaaatctgaacagttgtgtaatgaagaagaaaaggaacaattggacccgaaaccccaagtgtcagggagacccccagtcatcaagcctgaggtggactcaactttttgccacaattatgtgtttcccatacaaacactggactgcaaaaggaaagagttgaaaaaagtgccaaacaacatccctccagatattgttaaacttgacttgtcatacaataaaatcaaccaacttcgacccaaggaatttgaagatgttcatgagctgaagaaattaaacctcagcagcaatggcattgaattcatcgatcctgccgcttttttagggctcacacatttagaagaattagatttatcaaacaacagtctgcaaaactttgactatggcgtattagaagacttgtattttttgaaactcttgtggctcagagataacccttggagatgtgactacaacattcactacctctactactggttaaagcaccactacaatgtccattttaatggcctggaatgcaaaacgcctgaagaatacaaaggatggtctgtgggaaaatatattagaagttactatgaagaatgccccaaagacaagttaccagcatatcctgagtcatttgaccaagacacagaagatgatgaatgggaaaaaaaacatagagatcacaccgcaaagaagcaaagcgtaataattactatagtaggataaggtagaaattgttctgattgtaattagttttgtattttctatactggtgttagaaaacatatgtttacatttgattaactgtgttgcctatttatgcagggtaatccagctaaaggaagctttctttaattataagtattattgtgactattatagtaatcaagagaatgctatcatcctgcttgcctgtccatttgtggaacagcatctggtgatatgcaattccacactggtaacctgcagcagttgggtcctaatgatggcattagactttcataatgtcctgtataaatgtttttactgcttttagaaaataaagaaaaaaaacttggttcatgtttacatgcctttcgatagctgtttgtgcatacttaaagatgatcaaaatgattttatacaaatgctgttataataaaatgtcattccctacccctctactttttttcagtaagtcatcttatacattaaataaatttccatttctgatttctgtgcattcca

SEQ ID NO: 369448 - DNA, 1247 bp, Homo sapiens
ctgggacatgccattctaggctccaggtacccacacacgcatgctgtctacaacttccaggaagatagtaacattcccatttacagatgaggaaaatgaggctcaaagaggttcagtcacttgaccatggatctcacagagttgaaaaaagtgccaaacaacatccctccagatattgttaaacttgacttgtcatacaataaaatcaaccaacttcgacccaaggaatttgaagatgttcatgagctgaagaaattaaacctcagcagcaatggcattgaattcatcgatcctgggtctttgagatgaaaccctgcaagtagacttacgtgaatgatttttgctgtgccgcttttttagggctcacacatttagaagaattagatttatcaaacaacagtctgcaaaactttgactatggcgtattagaagacttgtattttttgaaactcttgtggctcagagataacccttggagatgtgactacaacattcactacctctactactggttaaagcaccactacaatgtccattttaatggcctggaatgcaaaacgcctgaagaatacaaaggatggtctgtgggaaaatatattagaagttactatgaagaatgccccaaagacaagttaccagcatatcctgagtcatttgaccaagacacagaagatgatgaatgggaaaaaaaacatagagatcacaccgcaaagaagcaaagcgtaataattactatagtaggataaggtagaaattgttctgattgtaattagttttgtattttctatactggtgttagaaaacatatgtttacatttgattaactgtgttgcctatttatgcagggtaatccagctaaaggaagctttctttaattataagtattattgtgactattatagtaatcaagagaatgctatcatcctgcttgcctgtccatttgtggaacagcatctggtgatatgcaattccacactggtaacctgcagcagttgggtcctaatgatggcattagactttcataatgtcctgtataaatgtttttactgcttttagaaaataaagaaaaaaaacttggttcatgtttacatgcctttcgatagctgtttgtgcatacttaaagatgatcaaaatgattttatacaaatgctgttataataaaatgtcattccctacccctctactttttttcagtaagtcatcttatacattaaataaatttccatttctgatttctgtgcattcca

SEQ ID NO: 369449 - DNA, 2163 bp, Homo sapiens
ggaaaatttcagcagctggggccatgtaatttaaaacctctgaaaagtgtgctgcggtccgtgcacagcattagtataacgtgagggctgaatgcagcccattctctggagaacttcctcacacaccgcagcaaagagaagactgaaagacaaacctgggtgcagccagagaggtccagatagatgagcttgtggcatccattccccaagttcagcctagggactccacgtaccccagctgggtctcattgttccagaactgcattagttaagattacccagacttggatttcaaaggaatactttcattgttccgtctgtaacacgaagtaattggggccagctggatgtcaggatgcgtgtggttaccattgtaatcttgctctgcttttgcaaagcggctgagctgcgcaaagcaagcccaggcagtgtgagaagccgagtgaatcatggccgggcgggtggaggccggagaggctccaacccggtcaaacgctacgcaccaggcctcccgtgtgacgtgtacacatatctccatgagaaatacttagattgtcaagaaagaaaattagtttatgtgctgcctggttggcctcaggatttgctgcacatgctgctagcaagaaacaagatccgcacattgaagaacaacatgttttccaagtttaaaaagctgaaaagcctggatctgcagcagaatgagatctctaaaattgagagtgaggcgttctttggtttaaacaaactcaccaccctcttactgcagcacaaccagatcaaagtcttgacggaggaagtgttcatttacacacctctcttgagctacctgcgtctttatgacaacccctggcactgtacttgtgagatagaaacgcttatttcaatgttgcagattcccaggaaccggaatttggggaactacgccaagtgtgaaagtccacaagaacaaaaaaataaaaaactgcggcagataaaatctgaacagttgtgtaatgaagaagaaaaggaacaattggacccgaaaccccaagtgtcagggagacccccagtcatcaagcctgaggtggactcaactttttgccacaattatgtgtttcccatacaaacactggactgcaaaaggaaagagttgaaaaaagtgccaaacaacatccctccagatattgttaaacttgacttgtcatacaataaaatcaaccaacttcgacccaaggaatttgaagatgttcatgagctgaagaaattaaacctcagcagcaatggcattgaattcatcgatcctgggtctttgagatgaaaccctgcaagtagacttacgtgaatgatttttgctgtgccgcttttttagggctcacacatttagaagaattagatttatcaaacaacagtctgcaaaactttgactatggcgtattagaagacttgtattttttgaaactcttgtggctcagagataacccttggagatgtgactacaacattcactacctctactactggttaaagcaccactacaatgtccattttaatggcctggaatgcaaaacgcctgaagaatacaaaggatggtctgtgggaaaatatattagaagttactatgaagaatgccccaaagacaagttaccagcatatcctgagtcatttgaccaagacacagaagatgatgaatgggaaaaaaaacatagagatcacaccgcaaagaagcaaagcgtaataattactatagtaggataaggtagaaattgttctgattgtaattagttttgtattttctatactggtgttagaaaacatatgtttacatttgattaactgtgttgcctatttatgcagggtaatccagctaaaggaagctttctttaattataagtattattgtgactattatagtaatcaagagaatgctatcatcctgcttgcctgtccatttgtggaacagcatctggtgatatgcaattccacactggtaacctgcagcagttgggtcctaatgatggcattagactttcataatgtcctgtataaatgtttttactgcttttagaaaataaagaaaaaaaacttggttcatgtttacatgcctttcgatagctgtttgtgcatacttaaagatgatcaaaatgattttatacaaatgctgttataataaaatgtcattcccta

SEQ ID NO: 369450 - DNA, 3084 bp, Homo sapiens
ggaaaatttcagcagctggggccatgtaatttaaaacctctgaaaagtgtgctgcggtccgtgcacagcattagtataacgtgagggctgaatgcagcccattctctggagaacttcctcacacaccgcagcaaagagaagactgaaagacaaacctgggtgcagccagagaggtccagatagatgagcttgtggcatccattccccaagttcagcctagggactccacgtaccccagctgggtctcattgttccagaactgcattagttaagattacccagacttggatttcaaaggaatactttcattgttccgtctgtaacacgaagtaattggggccagctggatgtcaggatgcgtgtggttaccattgtaatcttgctctgcttttgcaaagcggctgagctgcgcaaagcaagcccaggcagtgtgagaagccgagtgaatcatggccgggcgggtggaggccggagaggctccaacccggtcaaacgctacgcaccaggcctcccgtgtgacgtgtacacatatctccatgagaaatacttagattgtcaagaaagaaaattagtttatgtgctgcctggttggcctcaggatttgctgcacatgctgctagcaagaaacaagatccgcacattgaagaacaacatgttttccaagtttaaaaagctgaaaagcctggatctgcagcagaatgagatctctaaaattgagagtgaggcgttctttggtttaaacaaactcaccaccctcttactgcagcacaaccagatcaaagtcttgacggaggaagtgttcatttacacacctctcttgagctacctgcgtctttatgacaacccctggcactgtacttgtgagatagaaacgcttatttcaatgttgcagattcccaggaaccggaatttggggaactacgccaagtgtgaaagtccacaagaacaaaaaaataaaaaactgcggcagataaaatctgaacagttgtgtaatgaagaagaaaaggaacaattggacccgaaaccccaagtgtcagggagacccccagtcatcaagcctgaggtggactcaactttttgccacaattatgtgtttcccatacaaacactggactgcaaaaggaaagagttgaaaaaagtgccaaacaacatccctccagatattgttaaacttgacttgtcatacaataaaatcaaccaacttcgacccaaggaatttgaagatgttcatgagctgaagaaattaaacctcagcagcaatggcattgaattcatcgatcctgggtctttgagatgaaaccctgcaagtagacttacgtgaatgatttttgctgtggtaagtatacaaatgcagtgggagttgccagactttaaaagacgtgaataacaatcatataaaatgccagacattgttgtggaaaagagaaagaagataccctactagggggtttttacctcctttaagaaacagactaaaactagttttctcaagtgcctgaatatatatggtttaaataacaatatacaacactttcaaaataaaatctaggaatgtttacatatgcttttaatctcaaagtctaatgtcttgagaaaagtaaatctgtgagatcactgactcacagaattttagcaaatagaaaaaatccagtatcttcagaacacaagggctgatcttttgtcccctacccgcaagacattgcttggtaccaaaatagaaagttatttttttaagggggaattatgggttttttctgagaacagataatatgaaaatagttaatagtattggtatgaccacatattttcctaattcaaaataaggacgctatgctctacaagagtattttaaaacaataatgagataatgtttgaaatagaaacaaaatatttgtgagtatttctggagtatctggctggtccatatcaactggaatacagataacccaggtgtagatttctttgctcttagagggtgaaaaaagctttttgttgttttattttcagttatattggttttaattatccagcctccagcaaaattaaatacatatggattcaaagctgatagctaccatagtttgccaaaatacaaccagatgttttcaaaatgtggaaaaattgtttttggactctacaggaatagaacccttcccccaacactgggaaaaggttgttttctaggcattttcagtgttactgatatcccaggaactgtcagatcaccacccggcacatttttcatttttatctgcacttgtcttacatgcgaaatattttcttaattcatgtctcttttttgtagcatctttttttcccaagtaaataccaaaaaaaaaaaagcccaaaatacattttttaaagctaacttaaaactgaatattgtattctagtaaaactaatcaagggaaaagctttgagtaacaatatatttcacaattttgcatttagacacatttacagtgaagaaatataattaaaaacaaaaccttctatcaatccagaaattctctccacaaaggtagtaacgaaagaaacactttcattattgactaagcattaaaccagaatgtgacgcatatcacaggcaatccactaagagactgcaaagactctcgccactatgtaaccaggcagataccacccattacaggaatctcatccctgtgtagccaagcagataccacccattacatatacgttttcaggacaagcaataacgaatccttaaggaagaagatttgacaacaccttttgtcacacataattcatcctaactttacctggtaaatggagtgaccatctgtgttagcttattggccttattcagagaaaaataaatttctgtcttcatgacaggaggtagttttgcaactggaagcaagatctcaccaaagttaggaccccaccttcccaccagagctgggagatgtccttggaaaatacattcttgcatcataaaggtgacaaaaagcctatctagtcttcaaaaggatttaaagacatttcaaagagaggagaaagtacttatagttaaaagttttctaaagtaaaagctctgagaaaaagaaaggaaaagaaatc

SEQ ID NO: 369451 - DNA, 1288 bp, Homo sapiens
ggaaaatttcagcagctggggccatgtaatttaaaacctctgaaaagtgtgctgcggtccgtgcacagcattagtataacgtgagggctgaatgcagcccattctctggagaacttcctcacacaccgcagcaaagagaagactgaaagacaaacctgggtgcagccagagaggtccagatagatgagcttgtggcatccattccccaagttcagcctagggactccacgtaccccagctgggtctcattgttccagaactgcattagttaagattacccagacttggatttcaaaggaatactttcattgttccgtctgtaacacgaagtaattggggccagctggatgtcaggatgcgtgtggttaccattgtaatcttgctctgcttttgcaaagcggctgagctgcgcaaagcaagcccaggcagtgtgagaagccgagtgaatcatggccgggcgggtggaggccggagaggctccaacccggtcaaacgctacgcaccaggcctcccgtgtgacgtgtacacatatctccatgagaaatacttagattgtcaagaaagaaaattagtttatgtgctgcctggttggcctcaggatttgctgcacatgctgctagcaagaaacaagatccgcacattgaagaacaacatgttttccaagtttaaaaagctgaaaagcctggatctgcagcagaatgagatctctaaaattgagagtgaggcgttctttggtttaaacaaactcaccaccctcttactgcagcacaaccagatcaaagtcttgacggaggaagtgttcatttacacacctctcttgagctacctgcgtctttatgacaacccctggcactgtacttgtgagatagaaacgcttatttcaatgttgcagattcccaggaaccggaatttggggaactacgccaagtgtgaaagtccacaagaacaaaaaaataaaaaactgcggcagataaaatctgaacagttgtgtaatgaagaagaaaaggaacaattggacccgaaaccccaagtgtcagggagacccccagtcatcaagcctgaggtggactcaactttttgccacaattatgtgtttcccatacaaacactggactgcaaaaggaaaggtttgtacttttcttactttttcattttcatgaataacttgaaatgctctttgaatcttataatcctccctacatcccaccatgtcttggaattcgtgatgtcacttccaccagaaatccttccctattgacaatggaatttaccacaagtttttctgggg

SEQ ID NO: 369452 - DNA, 909 bp, Homo sapiens
caggaagtaagtacagccctggaattcccctcctactggaaaactggacaacaagcaatacatgattatgatccctaggaaaagagaaacaaatacggttcattccagcctgaagacattttcgatagcggcatgctgggcagttttttcttcgaattttatcgatgatgcaatcattccttccagcacatagagacggggtctcgttatgttgctcaggctggtctcaaactccaggcctcaagcaatcctcccatcttggcctcccaaattgctgggataataggtgtgagccacagtgcacagcccattttccttgagccacagtgcccagcccattttcctgtcaacccttctgataagacaatgagatatcttattttggagttcctgtgtcttctactacttggtaaattccctttctaactaatagaaagatgagtcttcaagtcagctgaaattttgtgactttgttttgtttatatggtattcatttttgtggttaaagtctatttttggcaaataattctggttttctatttatggtgggtgtggtagccagcctcccaagatggcccccagtgatctctgcctccttgaatgcatggtcttgtgcagtccctttccgtcctttaccaagattggtctgtgtggccaataaaatatggcagaagtgatggcatgttacatgtgaaatcagataataaaagacaatagttctgctgcattgatcacatactctcttggatcatttgttatgggggatgtaaattataatgctactcacgttactccacagagaccacaaggatgccagctttggccagtgtagtagtcccacctattgattagagtcaaaagtaaagcccacccctgcctagtgtaaagctctgaataaagtgcaacaac

SEQ ID NO: 369453 - DNA, 391 bp, Homo sapiens
caggaagtaagtacagccctggaattcccctcctactggaaaactggacaacaagcaatacatgattatgatccctaggaaaagagaaacaaatacgaaccagtccaaatgcccatcaatcaacgagtggataaagaaaatgtggtatatatataccatggaatactactcagccacaaaaaggaacaaaataatggcatttgcagcaacctggatggaactggaaaccattattgttcattccagcctgaagacattttcgatagcggcatgctgggcagttttttcttcgaattttatcgatgatgcaatcattccttccagcacataggtaattgtgctgtcctatatggaataaaaggcactattaaagtttcacaggtcttcaaac

SEQ ID NO: 369454 - DNA, 882 bp, Homo sapiens
caggaagtaagtacagccctggaattcccctcctactggaaaactggacaacaagcaatacatgattatgatccctaggaaaagagaaacaaatacggttcattccagcctgaagacattttcgatagcggcatgctgggcagttttttcttcgaattttatcgatgatgcaatcattccttccagcacatagagacggggtctcgttatgttgctcaggctggtctcaaactccaggcctcaagcaatcctcccatcttggcctcccaaattgctgggataataggtgtgagccacagtgcacagcccattttccctgtcaacccttctgataagacaatgagatatcttattttggagttcctgtgtcttctactacttggtaaattccctttctaactaatagaaagatgagtcttcaagtcagctgaaattttgtgactttgttttgtttatatggtattcatttttgtggttaaagtctatttttggcaaataattctggttttctatttatggtgggtgtggtagccagcctcccaagatggcccccagtgatctctgcctccttgaatgcatggtcttgtgcagtccctttccgtcctttaccaagattggtctgtgtggccaataaaatatggcagaagtgatggcatgttacatgtgaaatcagataataaaagacaatagttctgctgcattgatcacatactctcttggatcatttgttatgggggatgtaaattataatgctactcacgttactccacagagaccacaaggatgccagctttggccagtgtagtagtcccacctattgattagagtcaaaagtaaagcccacccctgcctagtgtaaagctctgaataaagtgcaacaac

SEQ ID NO: 369455 - DNA, 460 bp, Homo sapiens
caggaagtaagtacagccctggaattcccctcctactggaaaactggacaacaagcaatacatgattatgatccctaggaaaagagaaacaaatacgatccatccactgccttttcaactgcatttatatttccatcccttgtttttaaacttactaaatatacagaaccagtccaaatgcccatcaatcaacgagtggataaagaaaatgtggtatatatataccatggaatactactcagccacaaaaaggaacaaaataatggcatttgcagcaacctggatggaactggaaaccattattgttcattccagcctgaagacattttcgatagcggcatgctgggcagttttttcttcgaattttatcgatgatgcaatcattccttccagcacataggtaattgtgctgtcctatatggaataaaaggcactattaaagtttcacaggtcttcaaac

SEQ ID NO: 369456 - DNA, 930 bp, Homo sapiens
ctttttcttataaccttttagagagacagagaacagaaatcaatgtataattaatatcagtaatatggtgggtccctattctttgaaagtttgggcttttcatgtagattgagatcaagtatttctttatctttcttaaggtggcagtagtaaggctaaataacattcctcccgattccacccccgccagagtccccaggcctggctcccaacaagggaatggagagctgccagtgtgtactgcttgtgggcttctcccttgccgtggatgcctcttccctcagctgtcaggacggtcatgctttgttcagagagggataatgtcacagcacaatttgcctcctgctgagaatagacatgttctgcccctgggtgaatctttatcatttcagttcacccacaactatttccttctgtgccctccttaagcttcaagccccatcccatccagcctgcacatgcacagcttaggtagcttggagggaataaggtcctagaggactgatgactccctgcctccagggagatctctgatctccacctcggagacaggggagatagacaggggagccacagtggcaagaacttggcgccttctactccagacactcgctcttaagaaaggtggtctcttccctactctctggcattttgctctggcattcctagagcgtcctgtcctgccttgtgattctgtggttgtgaaggttctaattctgctgaacccagatcttttggctttgcatgcacactgtactgtattggggtaaaagtgaaaacttgcatttacctgttaatggcatccctgagctaaggatgcatttgaggtaccatctccctactgggaagaatctaagcagcccacttgctctcctgcctggctggaaacaccaaaaggggctgtcagcagctgtcagagggcagagggtc

SEQ ID NO: 369457 - DNA, 454 bp, Homo sapiens
tattgtagtcccaaaataaaaatatattaactcttctttatagaaaggagatggatccataaagatagactcaacatatttccgatgaagtacattattcagagtatgatctctaaccacaaagggattaagctagcatttatttatttatttatttttaaacgataacctccaaatcccaaactccatagaaattaggatacctctaattattccagggtcaaagaagaactcaaaatgcaaattgaaaatgtttaaaatgaaagataatgaagctataaaacattttaaagtgtggaatacaggtaaagcaaatttttgaaagaaatttttaggcttaatcatatatattagaaaaactatcaaggctaaaaatcagtggttgaaatattcattccaaaattctggaagaagtaagtcagatgaaaccaaagaatgtacaagacaagtacca

SEQ ID NO: 369458 - DNA, 465 bp, Homo sapiens
caaggaagcagaagtctgtaaaagagatctcttcatatacaccaaaggactgtacttcaagaaatggtccagaaaggggatgtgacagaggaataatagtatcaacacgtttgttgactgattctagcactgatgctttggaaaaagtgtccacatcgaatgaagatttctctttaaaggatgatgctcttgctaaaacctcaaaacgaaaaactaaggtacagaaagatgaaatctgtgcaaagttatcacatgtaataaagaagcaacacaggaagagtactttggtcgataatactatcaatttagatgaaaatttgactgtatctaacattgagagtttctattcaaggaaagatacaggagttcagaaaggagatggtttcatacacaatctttctttagaccctagtggtgttctggatgataagaatggagaacaaaaatctcaaaacaatgtattgc

SEQ ID NO: 369459 - DNA, 423 bp, Homo sapiens
gaggcggaggttgcagtgagttgagatcgcaccactgcactccagcctgggtgacagagcaagattctgttcccctccccaaaaatagggaatcttgacccctagttctgaccaagcacaaaaattactttgagaggaatcataaatctttggaaaattggcaatatctgcggaagccaagcaggtgaacaccctgtggtccagaagccccccttccccgccagggcatgcccaacagaaataatgagaacttaagtcaccaaaagacacatgtaagagccatcagatctccattgttcaataggcccaaactggtatctacaggatggacatgtggcttagtggtgtcatggagtaccacgcaccacaaacaaccacatcctcctccaggcagcagtgcgggccacatctagtgaagaaagc

SEQ ID NO: 369460 - DNA, 434 bp, Homo sapiens
cttttaagagcagacagagctggcctgggcccaggagctgggcttgggcattaggcattcagttaacaggcgttcctggcacccaccatgtgcagcacacacaggggcctggggcccatcccagcctgccaggtgctcctcaggccgggggaggagctcactgagccaggctgggggctggggtgggctttaggggtctactgaaggctatatgtacatgtacatgggccttaccccagaaaagaggtccaaaactttgctccaactctcaaaggcaatcatgaccctgaaagaagaagaacccctaaactgggggacatcttctgcgtgttggcttctttttttttttttttacttatttatttacttttgagacagagtcttgttctgcactccagcctggcaacagagcgagactccatcttaaaaaaaaa

SEQ ID NO: 369461 - DNA, 1264 bp, Homo sapiens
tccccgccccggccgccgcggcccggcgctgaccagctcggtccgcccgcctctgaccttctgttctcgccggtctccgtgcggcggcatctccgtgtccctgtgactcgagaccgcggctgtcgggtctccccctctctgaccctgcgtctctgtccccgctgtgtccgccctctctccgtgactctgtgtgtctctcgctgtcttgctgtggctgtcactcccaggctgtctcccagtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagcttcgccggcagctggaggagcgcttcggcgagagccccttccgcgacgaggaggagttgcgcgcgctgctgccgctgtgcaagcgctgccggcagggctccgcgacctcggcctcctccgccgggccgcactcagcagcctccgagggaaccgtgcagcgcctggtgccgcgcacgccccgggaagcccaccggccgctgccgctgctggcgcgcgtcaagcagactttctcttgcctcccccggtgtctgtcccgcaagggcggcaagtgaggatgcagtccagccgtggctccccacttccgactggctcccttcgggggctgtctgcgccttccacgccccccaggacgggcccagaggctgggggagccccgcggcggcctgaaccctgcctcccgcgcccgccctgctcgtccgcgtctgcagtcagcgtccccaacctgtgcgtctctgtgtccgggccggcctgctgcagccacctggtgccttagtccttgggctgggggagggggcccacccttaaaggcggcgggaggggagggagggagagtggagggtttgacgggcctggagggtattaaagagacacagaagaagctgcctgtcaga

SEQ ID NO: 369462 - DNA, 1215 bp, Homo sapiens
cctcggctctctccggggctgtttctccatcctgtcccgcctctgcctgtcattgcctttctgcctccccagccccagaatttccatccctgcaccctgcaagtctacctctctcctctcctctcctcctaagacctgccttcctcctctcccctctcatacccaagctggcctcccttggttccctcggtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagcttcgccggcagctggaggagcgcttcggcgagagccccttccgcgacgaggaggagttgcgcgcgctgctgccgctgtgcaagcgctgccggcagggctccgcgacctcggcctcctccgccgggccgcactcagcagcctccgagggaaccgtgcagcgcctggtgccgcgcacgccccgggaagcccaccggccgctgccgctgctggcgcgcgtcaagcagactttctcttgcctcccccggtgtctgtcccgcaagggcggcaagtgaggatgcagtccagccgtggctccccacttccgactggctcccttcgggggctgtctgcgccttccacgccccccaggacgggcccagaggctgggggagccccgcggcggcctgaaccctgcctcccgcgcccgccctgctcgtccgcgtctgcagtcagcgtccccaacctgtgcgtctctgtgtccgggccggcctgctgcagccacctggtgccttagtccttgggctgggggagggggcccacccttaaaggcggcgggaggggagggagggagagtggagggtttgacgggcctggagggtattaaagagacacagaagaagctgcctgtcaga

SEQ ID NO: 369463 - DNA, 473 bp, Homo sapiens
gcttgggatggagccaagcagacagtgctgccccttgggaatcttgctcccagcctgctgctgcccatcattgtgcccaggtgctctgattgcagaccccagaggagtgggacccctgtgtttcctccctcccatttctctgaaaggccacaataaacccaacatgaaaacagggtccacaggaggagtgctcctgcctagatggtgagatttgtcctgactggtctctctcactgcctgaaatgccaccattcttgcttcacacaaacacacctccagctcatactaagtactggcccatattcactgcatgtgctggctgacctggggaccccagggctctatgtcccttgctatcctgtaattggggtgggggcggaacaactcctgagaggtctgccctgcagtgctccctaccctattgctttctcctctagcaaaaagcacttcaaagaatgtatcaacttcatcca

SEQ ID NO: 369464 - DNA, 1459 bp, Homo sapiens
cccgcgcctgccggtgccagggtggggtaaggcccccgcccccacctccggaggtggcggccccacgcggccccaacaaactgccgttgtcccgcgggccgtgggcccggcacactggggctttgtccggccccccgccgcgacccgaggcgggggccccacatgaccgaaggggtaggaggagcctgcggcggcggcggtggcagcggcggctccaccaccatttccctcccgggccgggggtcggcgggcggtggcggtggctgggcagggctgggcagggccgcggacgccaggccccccgttccccgccaggctgcaggcgtcgggcctgggccgtcagggcagctgtgaccggatcgcttcccgggcggcgagctgggggtgcacccggaccgccgcccccgggatcatgggcaatggcatgaccaaggtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagcttcgccggcagctggaggagcgcttcggcgagagccccttccgcgacgaggaggagttgcgcgcgctgctgccgctgtgcaagcgctgccggcagggctccgcgacctcggcctcctccgccgggccgcactcagcagcctccgagggaaccgtgcagcgcctggtgccgcgcacgccccgggaagcccaccggccgctgccgctgctggcgcgcgtcaagcagactttctcttgcctcccccggtgtctgtcccgcaagggcggcaagtgaggatgcagtccagccgtggctccccacttccgactggctcccttcgggggctgtctgcgccttccacgccccccaggacgggcccagaggctgggggagccccgcggcggcctgaaccctgcctcccgcgcccgccctgctcgtccgcgtctgcagtcagcgtccccaacctgtgcgtctctgtgtccgggccggcctgctgcagccacctggtgccttagtccttgggctgggggagggggcccacccttaaaggcggcgggaggggagggagggagagtggagggtttgacgggcctggagggtattaaagagacacagaagaagctgcctgtcaga

SEQ ID NO: 369465 - DNA, 1081 bp, Homo sapiens
cccgcgcctgccggtgccagggtggggtaaggcccccgcccccacctccggaggtggcggccccacgcggccccaacaaactgccgttgtcccgcgggccgtgggcccggcacactggggctttgtccggccccccgccgcgacccgaggcgggggccccacatgaccgaaggggtaggaggagcctgcggcggcggcggtggcagcggcggctccaccaccatttccctcccgggccgggggtcggcgggcggtggcggtggctgggcagggctgggcagggccgcggacgccaggccccccgttccccgccaggctgcaggcgtcgggcctgggccgtcagggcagctgtgaccggatcgcttcccgggcggcgagctgggggtgcacccggaccgccgcccccgggatcatgggcaatggcatgaccaaggtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatgtgctctgattgcagaccccagaggagtgggacccctgtgtttcctccctcccatttctctgaaaggccacaataaacccaacatgaaaacagggtccacaggaggagtgctcctgcctagatgcaaaaagcacttcaaagaatgtatcaacttcatccactgctgccgccttaatggggggaactgccttgtgcactggtgagttaagcggagggggataaggtgggggaggaaggaagtggctgtgccctctgctgaacacacactccccctgtgggaaggttggacctgtgagggatcttctccagcctgtcacagtgcctgagggcccaccattcactggagagaggccaacccgggactctattccttatgagctgtgtggccatagccaagtagctgtttctctctgagactcaatgtcctcatctgtaaaatgcggaaaagaaagctgacctgatgggactgttgggagggata

SEQ ID NO: 369466 - DNA, 732 bp, Homo sapiens
ggataatcaagatatagtgttagtctattcatacaatggaaaatgaacgggcataaaagagaatgacatgacccgtgctacaatgtggagcaatcttgaaaatgtgctaagtgaaagaagccagcaagccatgctgaaacaagtcagcattcatacaatatgattcaatttatatgaaatacccagaacagaaaaatgtatagagacaggctgtagattagtggttgtctagggctgggggcaatagaaggcagagtgactgctaataggaagtttccttggagggatcatgaaaatgttctaaaatcagattatacgtccatttgcacaattttgtgaatatactcggaaccactgaattgtatactttaagtgggtgaggtatgtgaaaattaaatgtcagtaaagctgtttaaaaaagtttcatcccaaagctacattttacctaaggcaaatgtttactaccgcttctctttcagtcccaaataatttccagccatatgttccagtcaagcctcgacaaaattaaacaacaccacaacttactccagttacaagccaatgtgcaaatgccccaaacttgaccataaatttaccacccaacccccatcgtctcattcccaggaaaaactaaacacaagatcaactccccttgcaagttgaagtcctgacattgaagtctaaagaaattacagcccacaataaaattcttaaagtgtacaaacaaaaaat

SEQ ID NO: 369467 - DNA, 1641 bp, Homo sapiens
atcagcttctctgtgcttcttttcttatggatttttccatggcacatatgggaagtggggatcaaatgaggtcttttctgactgatacagaattgttttcccctacaggtttttgggggcatagttccaagcacactggcaattttgcctcattccttaatgcagaggtggccttaaagatgtggccttcttcattttctgttggtttggtttcgtttctatgagagatttcctctgatagctctgctttccccagcacttactctctgagcttttaaatgttctctctgggagcttcatataagctcggtgacatttgagccacagtttttagatcagcacctggaatacatgacacattcttactgaggtcatccagcactgccatggtggctgcccagtcttctggccagtgtgccaggcacatgtccctgtcacacaggttccaagaaacacatacgcagccatgcatagaccaacagatttaatattatattgcagttttcagcgatgcagaatgcagctgcaattgtgttttaaggagaagccaaatggggatggttgtccctgcaacatggtgccactcctgggccatgtgcagcctcagtggacactcttccatagcgctgaggccctggccccgcctccagttaccctgtactgcccactgccttacagttcagtgcgcaggccttcaccttttcatcaccagcctctctgctcagtgctctggagttcttgaccttgtcctttatcatgagatttgctgaaatcactaatgaaaataactcccaaaagcaacaaacaaaaatattagtttaactggcactgtggtatattaaaaggcacaagggcattgtggcttaacacttttgctggatcccaagagacgcacatgatgttaaaaagagatctggcagcagtactaatactacatttcagtgtaatcatcttggggtggtttggccaggatttcccaattccttgatatctggagtttcttcaccattgtccggcatcctgcggaggcttaatatacaggcgtaaggtcagcagcaatttgtctaataagtgatgagatcagtagctgaagtctctaagctgggccattactaaataccatagccatgttgatctggaaatttatccctctagtgtcttacctcacataagccatttgcccactgtgcaatatagaaaggtgttttcaaaagtatttggccgtagattttcacatccatcataaggttggcattcaataaggaaaaagttctaactccagtattaaattgtacataaatcccaaatgttcttaaagaacactcagggacatgtttgttgcctgggattggtaatgaaaggttggtttttgaaacttgaaatttcaccattggtttttttcctatcatttctgcatatccagcaaaaggaatctcatgttgactcctggcagagttcagtggcttcagtctgtctatctgttctgaggggaaaattgtgttctggatccagtaatcaatttggcaactttaatcgaggttttcaaaattccaaggagggttaataaagaatgataatcagttttatttgctaatagctaagacaaatttgtaataaagtgttttataatacttcaaaagc

SEQ ID NO: 369468 - DNA, 4271 bp, Homo sapiens
acgcagaaagtgccgccgctttggccactcagagcccccgggccgcggtcgtcgtacgcctgaaggcgggtcgtgccggcggccgctctagtctccgcctccgctcaggccggtcctccggggcttctcaatggtttcccggtggcctctcaatggttttcccggcggcccttgcgccgacgccaggagacttccggagcttggtgacgtcacgagcgagcttttctacccaaatacgcggcgggggaataggctcgagggcggtgagcagtgacaattgctaggcggagacagtgcagggaagagagaccttagaaaggatcaggactggcgggaggtatttaactgaaaggaatatctgcttcactgttgcaaccaaaccagatgccttcttccacttcaccagaccaaggagatgacctggagaactgcattttaagattttctgacctggatttaaaagatatgagtcttattaatcccagcagcagtcttaaagcagaattagatggcagtacaaaaaagaaatactcgtttgcaaagaaaaaggcctttgccctttttgtcaaaaccaaagaagttccaacaaaaaggagttttgaatgtaaagaaaaattgtggaaatgctgtcagcagctattcacagaccaaaccagcatccatagacatgtggcaacacaacatgctgatgaaatttatcaccagacagcttctattttaaagcaactggctgtgacattgagcacctcaaagagtctttcgtctgcagatgaaaagaaccctttaaaagagtgccttccacatagccatgacgtgtctgcttggctccctgatataagctgctttaaccctgatgagctgataagtggccagggcagtgaagaaggggaggtgctcctttattactgctaccatgacctggaggatccccaatggatctgtgcctggcagacagctctgtgtcagcacctgcacctcacaggcaagattcgaattgctgcagaaggaatcaatgggacagttggtggaagcaaattggctaccagactttatgtggaagtcatgctttccttcccattgtttaaggatgacctgtgtaaagatgattttaagaccagcaaaggaggagctcactgttttccagaattgcgtgttggtgtatttgaagaaatcgtgcccatggggatcagccccaaaaagatctcctacaagaagcctggaatccatttatccccaggtgaatttcataaagaagtagaaaagtttttatctcaggcaaatcaagaacaaagtgatactatccttcttgattgcagaaacttctatgaaagcaaaatagtggacgattccaaggctgcttagccccagacatcaggaaattcagttacttccctagctacgttgacaaaaatctagaacttttcagagagaagagagtgctgatgtactgtaccgggggcatccgctgtgagcggggttcagcctacctcaaagccaagggagtgtgcaaggaggtgttccagctcaagggtggcatccacaagtacctggaagagtttcctgatggcttttacaaagggaagttgtttgtttttgatgaacgctatgctctgtcctacaacagtgatgtggtgtcagagtgttcatactgtggagcccgctgggaccagtataaactctgctctactccccagtgccgccagctcgttttgacctgccctgcctgtcaaggacaaggattcacagcctgttgtgtcacatgtcaagacaaggggagcaggaaagtttcaggccctatgcaagacagctttaaagaggaatgcgagtgcacagcccgacggccacgcatacctagggaactcttgcagcatgtgcgacagcctgtgagcccagagccagggcctgatgctgatgaggatgggccagtgcttatgtgagcagcacctttggcattttcccaggccctcggtaaaagtaggtttggggtgactatacagagaaagcatggcaagactgcagaaacagagaaatcgggaacttcagttctggccgctgccaccgtggcagccgtctacacttcacagcgggaggggaggagtcacgttgtctaccacttacctgagacattctgatttggatgatgctagagcacagaaaataggtgagctgcatgggatcccaaagctgctgagggatagagcctgagcctggtggccacagcatatgccctttctgttccatgcagctggggctgttagtagtcattgcccttgtcagcagaccttctaccctggtggcaaacacatgaaagctgtggccctgggagtggcctcctaaaacaagccacttaggtcatctgccatctacccttaacctctgtctctcgcctgaggggaatctgcaagctgtgcattgggcttacctcctgcttttgtagaaataaccatcctttggtatacatggaggatagttccagaacgcctgagtatacaaaaacccaatgcatactcaagtcccacagtgggccctacagaacccacgtatgtgataaatcagccctccatgtacgcaggtttcgccccctgccaatactgtattttcaacctgtatggttgaaaaaaatccatatataagtgcagccatgcagttcaaacccatattgttcaagggtcaactgtatagtttattgaacagccacacccattcctttacacatgatctatggcagagttgaatagttgcaacagacactatgtggcctgcaaaatcggaaatttttactgtctggccttttacagtggccttaaagatgtggccttcttcattttctgttggtttggtttcgtttctatgagagatttcctctgatagctctgctttccccagcacttactctctgagcttttaaatgttctctctgggagcttcatataagctcggtgacatttgagccacagtttttagatcagcacctggaatacatgacacattcttactgaggtcatccagcactgccatggtggctgcccagtcttctggccagtgtgccaggcacatgtccctgtcacacaggttccaagaaacacatacgcagccatgcatagaccaacagatttaatattatattgcagttttcagcgatgcagaatgcagctgcaattgtgttttaaggagaagccaaatggggatggttgtccctgcaacatggtgccactcctgggccatgtgcagcctcagtggacactcttccatagcgctgaggccctggccccgcctccagttaccctgtactgcccactgccttacagttcagtgcgcaggccttcaccttttcatcaccagcctctctgctcagtgctctggagttcttgaccttgtcctttatcatgagatttgctgaaatcactaatgaaaataactcccaaaagcaacaaacaaaaatattagtttaactggcactgtggtatattaaaaggcacaagggcattgtggcttaacacttttgctggatcccaagagacgcacatgatgttaaaaagagatctggcagcagtactaatactacatttcagtgtaatcatcttggggtggtttggccaggatttcccaattccttgatatctggagtttcttcaccattgtccggcatcctgcggaggcttaatatacaggcgtaaggtcagcagcaatttgtctaataagtgatgagatcagtagctgaagtctctaagctgggccattactaaataccatagccatgttgatctggaaatttatccctctagtgtcttacctcacataagccatttgcccactgtgcaatatagaaaggtgttttcaaaagtatttggccgtagattttcacatccatcataaggttggcattcaataaggaaaaagttctaactccagtattaaattgtacataaatcccaaatgttcttaaagaacactcagggacatgtttgttgcctgggattggtaatgaaaggttggtttttgaaacttgaaatttcaccattggtttttttcctatcatttctgcatatccagcaaaaggaatctcatgttgactcctggcagagttcagtggcttcagtctgtctatctgttctgaggggaaaattgtgttctggatccagtaatcaatttggcaactttaatcgaggttttcaaaattccaaggagggttaataaagaatgataatcagttttatttgctaatagctaagacaaatttgtaataaagtgttttataatacttcaaaagc

SEQ ID NO: 369469 - DNA, 3662 bp, Homo sapiens
acgcagaaagtgccgccgctttggccactcagagcccccgggccgcggtcgtcgtacgcctgaaggcgggtcgtgccggcggccgctctagtctccgcctccgctcaggccggtcctccggggcttctcaatggtttcccggtggcctctcaatggttttcccggcggcccttgcgccgacgccaggagacttccggagcttggtgacgtcacgagcgagcttttctacccaaatacgcggcgggggaataggctcgagggcggtgagcagtgacaattgctaggcggagacagtgcagggaagagagaccttagaaaggatcaggactggcgggaggtatttaactgaaaggaatatctgcttcactgttgcaaccaaaccagatgccttcttccacttcaccagaccaaggagatgacctggagaactgcattttaagattttctgacctggatttaaaagatatgagtcttattaatcccagcagcagtcttaaagcagaattagatggcagtacaaaaaagaaatactcgtttgcaaagaaaaaggcctttgccctttttgtcaaaaccaaagaagttccaacaaaaaggagttttgaatgtaaagaaaaattgtggaaatgctgtcagcagctattcacagaccaaaccagcatccatagacatgtggcaacacaacatgctgatgaaatttatcaccagacagcttctattttaaagcaactggctgtgacattgagcacctcaaagagtctttcgtctgcagatgaaaagaaccctttaaaagagtgccttccacatagccatgacgtgtctgcttggctccctgatataagctgctttaaccctgatgagctgataagtggccagggcagtgaagaaggggaggtgctcctttattactgctaccatgacctggaggatccccaatggatctgtgcctggcagacagctctgtgtcagcacctgcacctcacaggcaagattcgaattgctgcagaaggaatcaatgggacagttggtggaagcaaattggctaccagactttatgtggaagtcatgctttccttcccattgtttaaggatgacctgtgtaaagatgattttaagaccagcaaaggaggagctcactgttttccagaattgcgtgttggtgtatttgaagaaatcgtgcccatggggatcagccccaaaaagatctcctacaagaagcctggaatccatttatccccaggtgaatttcataaagaagtagaaaagtttttatctcaggcaaatcaagaacaaagtgatactatccttcttgattgcagaaacttctatgaaagcaaaatagtcatggcaagactgcagaaacagagaaatcgggaacttcagttctggccgctgccaccgtggcagccgtctacacttcacagcgggaggggaggagtcacgttgtctaccacttacctgagacattctgatttggatgatgctagagcacagaaaataggtgagctgcatgggatcccaaagctgctgagggatagagcctgagcctggtggccacagcatatgccctttctgttccatgcagctggggctgttagtagtcattgcccttgtcagcagaccttctaccctggtggcaaacacatgaaagctgtggccctgggagtggcctcctaaaacaagccacttaggtcatctgccatctacccttaacctctgtctctcgcctgaggggaatctgcaagctgtgcattgggcttacctcctgcttttgtagaaataaccatcctttggtatacatggaggatagttccagaacgcctgagtatacaaaaacccaatgcatactcaagtcccacagtgggccctacagaacccacgtatgtgataaatcagccctccatgtacgcaggtttcgccccctgccaatactgtattttcaacctgtatggttgaaaaaaatccatatataagtgcagccatgcagttcaaacccatattgttcaagggtcaactgtatagtttattgaacagccacacccattcctttacacatgatctatggcagagttgaatagttgcaacagacactatgtggcctgcaaaatcggaaatttttactgtctggccttttacagaaaagtttgccagcccctgatctagaccagcagctcatctgatagaggcagaggtggccttaaagatgtggccttcttcattttctgttggtttggtttcgtttctatgagagatttcctctgatagctctgctttccccagcacttactctctgagcttttaaatgttctctctgggagcttcatataagctcggtgacatttgagccacagtttttagatcagcacctggaatacatgacacattcttactgaggtcatccagcactgccatggtggctgcccagtcttctggccagtgtgccaggcacatgtccctgtcacacaggttccaagaaacacatacgcagccatgcatagaccaacagatttaatattatattgcagttttcagcgatgcagaatgcagctgcaattgtgttttaaggagaagccaaatggggatggttgtccctgcaacatggtgccactcctgggccatgtgcagcctcagtggacactcttccatagcgctgaggccctggccccgcctccagttaccctgtactgcccactgccttacagttcagtgcgcaggccttcaccttttcatcaccagcctctctgctcagtgctctggagttcttgaccttgtcctttatcatgagatttgctgaaatcactaatgaaaataactcccaaaagcaacaaacaaaaatattagtttaactggcactgtggtatattaaaaggcacaagggcattgtggcttaacacttttgctggatcccaagagacgcacatgatgttaaaaagagatctggcagcagtactaatactacatttcagtgtaatcatcttggggtggtttggccaggatttcccaattccttgatatctggagtttcttcaccattgtccggcatcctgcggaggcttaatatacaggcgtaaggtcagcagcaatttgtctaataagtgatgagatcagtagctgaagtctctaagctgggccattactaaataccatagccatgttgatctggaaatttatccctctagtgtcttacctcacataagccatttgcccactgtgcaatatagaaaggtgttttcaaaagtatttggccgtagattttcacatccatcataaggttggcattcaataaggaaaaagttctaactccagtattaaattgtacataaatcccaaatgttcttaaagaacactcagggacatgtttgttgcctgggattggtaatgaaaggttggtttttgaaacttgaaatttcaccattggtttttttcctatcatttctgcatatccagcaaaaggaatctcatgttgactcctggcagagttcagtggcttcagtctgtctatctgttctgaggggaaaattgtgttctggatccagtaatcaatttggcaactttaatcgaggttttcaaaattccaaggagggttaataaagaatgataatcagttttatttgctaatagctaagacaaatttgtaataaagtgttttataatacttcaaaagc

SEQ ID NO: 369470 - DNA, 4297 bp, Homo sapiens
acgcagaaagtgccgccgctttggccactcagagcccccgggccgcggtcgtcgtacgcctgaaggcgggtcgtgccggcggccgctctagtctccgcctccgctcaggccggtcctccggggcttctcaatggtttcccggtggcctctcaatggttttcccggcggcccttgcgccgacgccaggagacttccggagcttggtgacgtcacgagcgagcttttctacccaaatacgcggcgggggaataggctcgagggcggtgagcagtgacaattgctaggcggagacagtgcagggaagagagaccttagaaaggatcaggactggcgggaggtatttaactgaaaggaatatctgcttcactgttgcaaccaaaccagatgccttcttccacttcaccagaccaaggagatgacctggagaactgcattttaagattttctgacctggatttaaaagatatgagtcttattaatcccagcagcagtcttaaagcagaattagatggcagtacaaaaaagaaatactcgtttgcaaagaaaaagaagttccaacaaaaaggagttttgaatgtaaagaaaaattgtggaaatgctgtcagcagctattcacagaccaaaccagcatccatagacatgtggcaacacaacatgctgatgaaatttatcaccagacagcttctattttaaagcaactggctgtgacattgagcacctcaaagagtctttcgtctgcagatgaaaagaaccctttaaaagagtgccttccacatagccatgacgtgtctgcttggctccctgatataagctgctttaaccctgatgagctgataagtggccagggcagtgaagaaggggaggtgctcctttattactgctaccatgacctggaggatccccaatggatctgtgcctggcagacagctctgtgtcagcacctgcacctcacaggcaagattcgaattgctgcagaaggaatcaatgggacagttggtggaagcaaattggctaccagactttatgtggaagtcatgctttccttcccattgtttaaggatgacctgtgtaaagatgattttaagaccagcaaaggaggagctcactgttttccagaattgcgtgttggtgtatttgaagaaatcgtgcccatggggatcagccccaaaaagatctcctacaagaagcctggaatccatttatccccaggtgaatttcataaagaagtagaaaagtttttatctcaggcaaatcaagaacaaagtgatactatccttcttgattgcagaaacttctatgaaagcaaaatagtggacgattccaaggctgcttagccccagacatcaggaaattcagttacttccctagctacgttgacaaaaatctagaacttttcagagagaagagagtgctgatgtactgtaccgggggcatccgctgtgagcggggttcagcctacctcaaagccaagggagtgtgcaaggaggtgttccagctcaagggtggcatccacaagtacctggaagagtttcctgatggcttttacaaagggaagttgtttgtttttgatgaacgctatgctctgtcctacaacagtgatgtggtgtcagagtgttcatactgtggagcccgctgggaccagtataaactctgctctactccccagtgccgccagctcgttttgacctgccctgcctgtcaaggacaaggattcacagcctgttgtgtcacatgtcaagacaaggggagcaggaaagtttcaggccctatgcaagacagctttaaagaggaatgcgagtgcacagcccgacggccacgcatacctagggaactcttgcagcatgtgcgacagcctgtgagcccagagccagggcctgatgctgatgaggatgggccagtgcttatgtgagcagcacctttggcattttcccaggccctcggtaaaagtaggtttggggtgactatacagagaaagcatggcaagactgcagaaacagagaaatcgggaacttcagttctggccgctgccaccgtggcagccgtctacacttcacagcgggaggggaggagtcacgttgtctaccacttacctgagacattctgatttggatgatgctagagcacagaaaataggtgagctgcatgggatcccaaagctgctgagggatagagcctgagcctggtggccacagcatatgccctttctgttccatgcagctggggctgttagtagtcattgcccttgtcagcagaccttctaccctggtggcaaacacatgaaagctgtggccctgggagtggcctcctaaaacaagccacttaggtcatctgccatctacccttaacctctgtctctcgcctgaggggaatctgcaagctgtgcattgggcttacctcctgcttttgtagaaataaccatcctttggtatacatggaggatagttccagaacgcctgagtatacaaaaacccaatgcatactcaagtcccacagtgggccctacagaacccacgtatgtgataaatcagccctccatgtacgcaggtttcgccccctgccaatactgtattttcaacctgtatggttgaaaaaaatccatatataagtgcagccatgcagttcaaacccatattgttcaagggtcaactgtatagtttattgaacagccacacccattcctttacacatgatctatggcagagttgaatagttgcaacagacactatgtggcctgcaaaatcggaaatttttactgtctggccttttacagaaaagtttgccagcccctgatctagaccagcagctcatctgatagaggcagaggtggccttaaagatgtggccttcttcattttctgttggtttggtttcgtttctatgagagatttcctctgatagctctgctttccccagcacttactctctgagcttttaaatgttctctctgggagcttcatataagctcggtgacatttgagccacagtttttagatcagcacctggaatacatgacacattcttactgaggtcatccagcactgccatggtggctgcccagtcttctggccagtgtgccaggcacatgtccctgtcacacaggttccaagaaacacatacgcagccatgcatagaccaacagatttaatattatattgcagttttcagcgatgcagaatgcagctgcaattgtgttttaaggagaagccaaatggggatggttgtccctgcaacatggtgccactcctgggccatgtgcagcctcagtggacactcttccatagcgctgaggccctggccccgcctccagttaccctgtactgcccactgccttacagttcagtgcgcaggccttcaccttttcatcaccagcctctctgctcagtgctctggagttcttgaccttgtcctttatcatgagatttgctgaaatcactaatgaaaataactcccaaaagcaacaaacaaaaatattagtttaactggcactgtggtatattaaaaggcacaagggcattgtggcttaacacttttgctggatcccaagagacgcacatgatgttaaaaagagatctggcagcagtactaatactacatttcagtgtaatcatcttggggtggtttggccaggatttcccaattccttgatatctggagtttcttcaccattgtccggcatcctgcggaggcttaatatacaggcgtaaggtcagcagcaatttgtctaataagtgatgagatcagtagctgaagtctctaagctgggccattactaaataccatagccatgttgatctggaaatttatccctctagtgtcttacctcacataagccatttgcccactgtgcaatatagaaaggtgttttcaaaagtatttggccgtagattttcacatccatcataaggttggcattcaataaggaaaaagttctaactccagtattaaattgtacataaatcccaaatgttcttaaagaacactcagggacatgtttgttgcctgggattggtaatgaaaggttggtttttgaaacttgaaatttcaccattggtttttttcctatcatttctgcatatccagcaaaaggaatctcatgttgactcctggcagagttcagtggcttcagtctgtctatctgttctgaggggaaaattgtgttctggatccagtaatcaatttggcaactttaatcgaggttttcaaaattccaaggagggttaataaagaatgataatcagttttatttgctaatagctaagacaaatttgtaataaagtgttttataatacttcaaaagc

SEQ ID NO: 369471 - DNA, 1355 bp, Homo sapiens
acgcagaaagtgccgccgctttggccactcagagcccccgggccgcggtcgtcgtacgcctgaaggcgggtcgtgccggcggccgctctagtctccgcctccgctcaggccggtcctccggggcttctcaatggtttcccggtggcctctcaatggttttcccggcggcccttgcgccgacgccaggagacttccggagcttggtgacgtcacgagcgagcttttctacccaaatacgcggcgggggaataggctcgagggcggtgagcagtgacaattgctaggcggagacagtgcagggaagagagaccttagaaaggatcaggactggcgggaggtatttaactgaaaggaatatctgcttcactgttgcaaccaaaccagatgccttcttccacttcaccagaccaaggagatgacctggagaactgcattttaagattttctgacctggatttaaaagatatgagtcttattaatcccagcagcagtcttaaagcagaattagatggcagtacaaaaaagaaatactcgtttgcaaagaaaaaggcctttgccctttttgtcaaaaccaaagaagttccaacaaaaaggagttttgaatgtaaagaaaaattgtggaaatgctgtcagcagctattcacagaccaaaccagcatccatagacatgtggcaacacaacatgctgatgaaatttatcaccagacagcttctattttaaagcaactggctgtgacattgagcacctcaaagagtctttcgtctgcagatgaaaagaaccctttaaaagagtgccttccacatagccatgacgtgtctgcttggctccctgatataagctgctttaaccctgatgagctgataagtggccagggcagtgaagaaggggaggtgctcctttattactgctaccatgacctggaggatccccaatggatctgtgcctggcagacagctctgtgtcagcacctgcacctcacaggcaagattcgaattgctgcagaaggaatcaatgggacagttggtggaagcaaattggctaccagactttatgtggaagtcatgctttccttcccattgtttaaggatgacctgtgtaaagatgattttaagaccagcaaaggaggagctcactgttttccagaattgcgtgttggtgtatttgaagaaatcgtgcccatggggatcagccccaaaaagatctcctacaagaagcctggtatgcttgcttttagaagattgtgctttaattcacagggacaaaacttaatagacaaataagaaagctaggcactgtgatcagcagcagtcatgagtcctctctaaagcagctgtggggtggctaacacttggct

SEQ ID NO: 369472 - DNA, 601 bp, Homo sapiens
ttttccaagaaggaagatattttggtacgtttcttcctggtctttttcaatgtactttttaatgtggttaagattacattgcataagcaattttatccaatttttttcacttaatattatatcataaaatatttttccatataacttaaaactggctgcttaatattccatggtaagcatacttcataatttactttccatattcctttcgaaaataactaatagtgttatttgtgatattttaggccaaactgtattatgtattttccagtgtgacttagtcttatatcctgagaataaaattatgatgctgagagttatttaacctcctcaatataaagcctagttttaatttctctaatagtctcttctaaagcttactaataagagaagtgttacttctcagagaattgtataacataatggaacataaaactagaagcccctgtggaaagataatctaaagaatcttagtgagacttctattagccataaacctaaggttatttaacagtgttagcatttgaaatctaattgcaggcctttgccctttttgtcaaaaccaaagaagttccaacaaaaaggagttttgaatgtaaag

SEQ ID NO: 369473 - DNA, 460 bp, Homo sapiens
gttttggtttttttgtctttgttttaatataatttttttggtttggttttaggaatccatttatccccaggtgaatttcataaagaagtagaaaagtttttatctcaggcaaatcaagaacaaagtgatactatccttcttgattgcagaaacttctatgaaagcaaaatagtaagtaaaagccagaactgagttctctgaattggtagatctccccattcccacagtgtggtatatttcccaaggggaccttgtgtgtgcccacctgtggccacatggatctcctcccagtactggcagcttcagagaaaacccaagtcctaaaactcagaaatctggtgagagagtctaagaaaatatgaattaaaggcatccaggcacataatatactttgtgactcccatgagcctgcctttgacatgtatcaaggatcttgcaaagttgcctttgggcagcctct

SEQ ID NO: 369474 - DNA, 4325 bp, Homo sapiens
acgcagaaagtgccgccgctttggccactcagagcccccgggccgcggtcgtcgtacgcctgaaggcgggtcgtgccggcggccgctctagtctccgcctccgctcaggccggtcctccggggcttctcaatggtttcccggtggcctctcaatggttttcccggcggcccttgcgccgacgccaggagacttccggagcttggtgacgtcacgagcgagcttttctacccaaatacgcggcgggggaataggctcgagggcggtgagcagtgacaattgctaggcggagacagtgcagggaagagagaccttagaaaggatcaggactggcgggaggtatttaactgaaaggaatatctgcttcactgttgcaaccaaaccagatgccttcttccacttcaccagaccaaggagatgacctggagaactgcattttaagattttctgacctggatttaaaagatatgagtcttattaatcccagcagcagtcttaaagcagaattagatggcagtacaaaaaagaaatactcgtttgcaaagaaaaaggcctttgccctttttgtcaaaaccaaagaagttccaacaaaaaggagttttgaatgtaaagaaaaattgtggaaatgctgtcagcagctattcacagaccaaaccagcatccatagacatgtggcaacacaacatgctgatgaaatttatcaccagacagcttctattttaaagcaactggctgtgacattgagcacctcaaagagtctttcgtctgcagatgaaaagaaccctttaaaagagtgccttccacatagccatgacgtgtctgcttggctccctgatataagctgctttaaccctgatgagctgataagtggccagggcagtgaagaaggggaggtgctcctttattactgctaccatgacctggaggatccccaatggatctgtgcctggcagacagctctgtgtcagcacctgcacctcacaggcaagattcgaattgctgcagaaggaatcaatgggacagttggtggaagcaaattggctaccagactttatgtggaagtcatgctttccttcccattgtttaaggatgacctgtgtaaagatgattttaagaccagcaaaggaggagctcactgttttccagaattgcgtgttggtgtatttgaagaaatcgtgcccatggggatcagccccaaaaagatctcctacaagaagcctggaatccatttatccccaggtgaatttcataaagaagtagaaaagtttttatctcaggcaaatcaagaacaaagtgatactatccttcttgattgcagaaacttctatgaaagcaaaatagtggacgattccaaggctgcttagccccagacatcaggaaattcagttacttccctagctacgttgacaaaaatctagaacttttcagagagaagagagtgctgatgtactgtaccgggggcatccgctgtgagcggggttcagcctacctcaaagccaagggagtgtgcaaggaggtgttccagctcaagggtggcatccacaagtacctggaagagtttcctgatggcttttacaaagggaagttgtttgtttttgatgaacgctatgctctgtcctacaacagtgatgtggtgtcagagtgttcatactgtggagcccgctgggaccagtataaactctgctctactccccagtgccgccagctcgttttgacctgccctgcctgtcaaggacaaggattcacagcctgttgtgtcacatgtcaagacaaggggagcaggaaagtttcaggccctatgcaagacagctttaaagaggaatgcgagtgcacagcccgacggccacgcatacctagggaactcttgcagcatgtgcgacagcctgtgagcccagagccagggcctgatgctgatgaggatgggccagtgcttatgtgagcagcacctttggcattttcccaggccctcggtaaaagtaggtttggggtgactatacagagaaagcatggcaagactgcagaaacagagaaatcgggaacttcagttctggccgctgccaccgtggcagccgtctacacttcacagcgggaggggaggagtcacgttgtctaccacttacctgagacattctgatttggatgatgctagagcacagaaaataggtgagctgcatgggatcccaaagctgctgagggatagagcctgagcctggtggccacagcatatgccctttctgttccatgcagctggggctgttagtagtcattgcccttgtcagcagaccttctaccctggtggcaaacacatgaaagctgtggccctgggagtggcctcctaaaacaagccacttaggtcatctgccatctacccttaacctctgtctctcgcctgaggggaatctgcaagctgtgcattgggcttacctcctgcttttgtagaaataaccatcctttggtatacatggaggatagttccagaacgcctgagtatacaaaaacccaatgcatactcaagtcccacagtgggccctacagaacccacgtatgtgataaatcagccctccatgtacgcaggtttcgccccctgccaatactgtattttcaacctgtatggttgaaaaaaatccatatataagtgcagccatgcagttcaaacccatattgttcaagggtcaactgtatagtttattgaacagccacacccattcctttacacatgatctatggcagagttgaatagttgcaacagacactatgtggcctgcaaaatcggaaatttttactgtctggccttttacagaaaagtttgccagcccctgatctagaccagcagctcatctgatagaggcagaggtggccttaaagatgtggccttcttcattttctgttggtttggtttcgtttctatgagagatttcctctgatagctctgctttccccagcacttactctctgagcttttaaatgttctctctgggagcttcatataagctcggtgacatttgagccacagtttttagatcagcacctggaatacatgacacattcttactgaggtcatccagcactgccatggtggctgcccagtcttctggccagtgtgccaggcacatgtccctgtcacacaggttccaagaaacacatacgcagccatgcatagaccaacagatttaatattatattgcagttttcagcgatgcagaatgcagctgcaattgtgttttaaggagaagccaaatggggatggttgtccctgcaacatggtgccactcctgggccatgtgcagcctcagtggacactcttccatagcgctgaggccctggccccgcctccagttaccctgtactgcccactgccttacagttcagtgcgcaggccttcaccttttcatcaccagcctctctgctcagtgctctggagttcttgaccttgtcctttatcatgagatttgctgaaatcactaatgaaaataactcccaaaagcaacaaacaaaaatattagtttaactggcactgtggtatattaaaaggcacaagggcattgtggcttaacacttttgctggatcccaagagacgcacatgatgttaaaaagagatctggcagcagtactaatactacatttcagtgtaatcatcttggggtggtttggccaggatttcccaattccttgatatctggagtttcttcaccattgtccggcatcctgcggaggcttaatatacaggcgtaaggtcagcagcaatttgtctaataagtgatgagatcagtagctgaagtctctaagctgggccattactaaataccatagccatgttgatctggaaatttatccctctagtgtcttacctcacataagccatttgcccactgtgcaatatagaaaggtgttttcaaaagtatttggccgtagattttcacatccatcataaggttggcattcaataaggaaaaagttctaactccagtattaaattgtacataaatcccaaatgttcttaaagaacactcagggacatgtttgttgcctgggattggtaatgaaaggttggtttttgaaacttgaaatttcaccattggtttttttcctatcatttctgcatatccagcaaaaggaatctcatgttgactcctggcagagttcagtggcttcagtctgtctatctgttctgaggggaaaattgtgttctggatccagtaatcaatttggcaactttaatcgaggttttcaaaattccaaggagggttaataaagaatgataatcagttttatttgctaatagctaagacaaatttgtaataaagtgttttataatacttcaaaagc

SEQ ID NO: 369475 - DNA, 4105 bp, Homo sapiens
acgcagaaagtgccgccgctttggccactcagagcccccgggccgcggtcgtcgtacgcctgaaggcgggtcgtgccggcggccgctctagtctccgcctccgctcaggccggtcctccggggcttctcaatggtttcccggtggcctctcaatggttttcccggcggcccttgcgccgacgccaggagacttccggagcttggtgacgtcacgagcgagcttttctacccaaatacgcggcgggggaataggctcgagggcggtgagcagtgacaattgctaggcggagacagtgcagggaagagagaccttagaaaggatcaggactggcgggaggtatttaactgaaaggaatatctgcttcactgttgcaaccaaaccagatgccttcttccacttcaccagaccaaggagatgacctggagaactgcattttaagattttctgacctggatttaaaagatatgagtcttattaatcccagcagcagtcttaaagcagaattagatggcagtacaaaaaagaaatactcgtttgcaaagaaaaagatgaaaagaaccctttaaaagagtgccttccacatagccatgacgtgtctgcttggctccctgatataagctgctttaaccctgatgagctgataagtggccagggcagtgaagaaggggaggtgctcctttattactgctaccatgacctggaggatccccaatggatctgtgcctggcagacagctctgtgtcagcacctgcacctcacaggcaagattcgaattgctgcagaaggaatcaatgggacagttggtggaagcaaattggctaccagactttatgtggaagtcatgctttccttcccattgtttaaggatgacctgtgtaaagatgattttaagaccagcaaaggaggagctcactgttttccagaattgcgtgttggtgtatttgaagaaatcgtgcccatggggatcagccccaaaaagatctcctacaagaagcctggaatccatttatccccaggtgaatttcataaagaagtagaaaagtttttatctcaggcaaatcaagaacaaagtgatactatccttcttgattgcagaaacttctatgaaagcaaaatagtggacgattccaaggctgcttagccccagacatcaggaaattcagttacttccctagctacgttgacaaaaatctagaacttttcagagagaagagagtgctgatgtactgtaccgggggcatccgctgtgagcggggttcagcctacctcaaagccaagggagtgtgcaaggaggtgttccagctcaagggtggcatccacaagtacctggaagagtttcctgatggcttttacaaagggaagttgtttgtttttgatgaacgctatgctctgtcctacaacagtgatgtggtgtcagagtgttcatactgtggagcccgctgggaccagtataaactctgctctactccccagtgccgccagctcgttttgacctgccctgcctgtcaaggacaaggattcacagcctgttgtgtcacatgtcaagacaaggggagcaggaaagtttcaggccctatgcaagacagctttaaagaggaatgcgagtgcacagcccgacggccacgcatacctagggaactcttgcagcatgtgcgacagcctgtgagcccagagccagggcctgatgctgatgaggatgggccagtgcttatgtgagcagcacctttggcattttcccaggccctcggtaaaagtaggtttggggtgactatacagagaaagcatggcaagactgcagaaacagagaaatcgggaacttcagttctggccgctgccaccgtggcagccgtctacacttcacagcgggaggggaggagtcacgttgtctaccacttacctgagacattctgatttggatgatgctagagcacagaaaataggtgagctgcatgggatcccaaagctgctgagggatagagcctgagcctggtggccacagcatatgccctttctgttccatgcagctggggctgttagtagtcattgcccttgtcagcagaccttctaccctggtggcaaacacatgaaagctgtggccctgggagtggcctcctaaaacaagccacttaggtcatctgccatctacccttaacctctgtctctcgcctgaggggaatctgcaagctgtgcattgggcttacctcctgcttttgtagaaataaccatcctttggtatacatggaggatagttccagaacgcctgagtatacaaaaacccaatgcatactcaagtcccacagtgggccctacagaacccacgtatgtgataaatcagccctccatgtacgcaggtttcgccccctgccaatactgtattttcaacctgtatggttgaaaaaaatccatatataagtgcagccatgcagttcaaacccatattgttcaagggtcaactgtatagtttattgaacagccacacccattcctttacacatgatctatggcagagttgaatagttgcaacagacactatgtggcctgcaaaatcggaaatttttactgtctggccttttacagaaaagtttgccagcccctgatctagaccagcagctcatctgatagaggcagaggtggccttaaagatgtggccttcttcattttctgttggtttggtttcgtttctatgagagatttcctctgatagctctgctttccccagcacttactctctgagcttttaaatgttctctctgggagcttcatataagctcggtgacatttgagccacagtttttagatcagcacctggaatacatgacacattcttactgaggtcatccagcactgccatggtggctgcccagtcttctggccagtgtgccaggcacatgtccctgtcacacaggttccaagaaacacatacgcagccatgcatagaccaacagatttaatattatattgcagttttcagcgatgcagaatgcagctgcaattgtgttttaaggagaagccaaatggggatggttgtccctgcaacatggtgccactcctgggccatgtgcagcctcagtggacactcttccatagcgctgaggccctggccccgcctccagttaccctgtactgcccactgccttacagttcagtgcgcaggccttcaccttttcatcaccagcctctctgctcagtgctctggagttcttgaccttgtcctttatcatgagatttgctgaaatcactaatgaaaataactcccaaaagcaacaaacaaaaatattagtttaactggcactgtggtatattaaaaggcacaagggcattgtggcttaacacttttgctggatcccaagagacgcacatgatgttaaaaagagatctggcagcagtactaatactacatttcagtgtaatcatcttggggtggtttggccaggatttcccaattccttgatatctggagtttcttcaccattgtccggcatcctgcggaggcttaatatacaggcgtaaggtcagcagcaatttgtctaataagtgatgagatcagtagctgaagtctctaagctgggccattactaaataccatagccatgttgatctggaaatttatccctctagtgtcttacctcacataagccatttgcccactgtgcaatatagaaaggtgttttcaaaagtatttggccgtagattttcacatccatcataaggttggcattcaataaggaaaaagttctaactccagtattaaattgtacataaatcccaaatgttcttaaagaacactcagggacatgtttgttgcctgggattggtaatgaaaggttggtttttgaaacttgaaatttcaccattggtttttttcctatcatttctgcatatccagcaaaaggaatctcatgttgactcctggcagagttcagtggcttcagtctgtctatctgttctgaggggaaaattgtgttctggatccagtaatcaatttggcaactttaatcgaggttttcaaaattccaaggagggttaataaagaatgataatcagttttatttgctaatagctaagacaaatttgtaataaagtgttttataatacttcaaaagc

SEQ ID NO: 369476 - DNA, 3351 bp, Homo sapiens
gctggactcgatgggtacctgcgtgtgagtatgaaggagagagggaaggctcagaggtagcttagataagcaaggtaaggaaaagtgaggaagaatgatgttatcaatagtaacaggaggtcatcagggaaaaacaggtgaagaagatggtgtgagttttaggaatcagatggtcaagtgccctagcaacagcaggagagacacaggcctcggggagaggggtgtggactgcgcatgttcactgtaggtgggttatcgcctgtatttaggtgtgttgtcccccctggaaaagggaacaatcaaagaggaaaagaccacttaacaagggggttgggaggtagttggccagctttggaatagctggtgagagagagaaactttcattaccatctagttaccacctgttctctagatgggaaaaagaaaaaaaaagtcagtaaatactggaagcagacagttaccagaagtcacccccacaaaaaaataagctgggtggtgggggtggtggttagttgttgttgctagaagacagaagacttactatttggaaaccttccccgggttccacaggatctacgagattctagtcagcaaagggagcaatgcctgtccacgtgtgtgtgaatgtatgtgtttataatgatggcttttccttcctccccagagtgttcatactgtggagcccgctgggaccagtataaactctgctctactccccagtgccgccagctcgttttgacctgccctgcctgtcaaggacaaggattcacagcctgttgtgtcacatgtcaagacaaggggagcaggaaagtttcaggccctatgcaagacagctttaaagaggaatgcgagtgcacagcccgacggccacgcatacctagggaactcttgcagcatgtgcgacagcctgtgagcccagagccagggcctgatgctgatgaggatgggccagtgcttatgtgagcagcacctttggcattttcccaggccctcggtaaaagtaggtttggggtgactatacagagaaagcatggcaagactgcagaaacagagaaatcgggaacttcagttctggccgctgccaccgtggcagccgtctacacttcacagcgggaggggaggagtcacgttgtctaccacttacctgagacattctgatttggatgatgctagagcacagaaaataggtgagctgcatgggatcccaaagctgctgagggatagagcctgagcctggtggccacagcatatgccctttctgttccatgcagctggggctgttagtagtcattgcccttgtcagcagaccttctaccctggtggcaaacacatgaaagctgtggccctgggagtggcctcctaaaacaagccacttaggtcatctgccatctacccttaacctctgtctctcgcctgaggggaatctgcaagctgtgcattgggcttacctcctgcttttgtagaaataaccatcctttggtatacatggaggatagttccagaacgcctgagtatacaaaaacccaatgcatactcaagtcccacagtgggccctacagaacccacgtatgtgataaatcagccctccatgtacgcaggtttcgccccctgccaatactgtattttcaacctgtatggttgaaaaaaatccatatataagtgcagccatgcagttcaaacccatattgttcaagggtcaactgtatagtttattgaacagccacacccattcctttacacatgatctatggcagagttgaatagttgcaacagacactatgtggcctgcaaaatcggaaatttttactgtctggccttttacagaaaagtttgccagcccctgatctagaccagcagctcatctgatagaggcagaggtggccttaaagatgtggccttcttcattttctgttggtttggtttcgtttctatgagagatttcctctgatagctctgctttccccagcacttactctctgagcttttaaatgttctctctgggagcttcatataagctcggtgacatttgagccacagtttttagatcagcacctggaatacatgacacattcttactgaggtcatccagcactgccatggtggctgcccagtcttctggccagtgtgccaggcacatgtccctgtcacacaggttccaagaaacacatacgcagccatgcatagaccaacagatttaatattatattgcagttttcagcgatgcagaatgcagctgcaattgtgttttaaggagaagccaaatggggatggttgtccctgcaacatggtgccactcctgggccatgtgcagcctcagtggacactcttccatagcgctgaggccctggccccgcctccagttaccctgtactgcccactgccttacagttcagtgcgcaggccttcaccttttcatcaccagcctctctgctcagtgctctggagttcttgaccttgtcctttatcatgagatttgctgaaatcactaatgaaaataactcccaaaagcaacaaacaaaaatattagtttaactggcactgtggtatattaaaaggcacaagggcattgtggcttaacacttttgctggatcccaagagacgcacatgatgttaaaaagagatctggcagcagtactaatactacatttcagtgtaatcatcttggggtggtttggccaggatttcccaattccttgatatctggagtttcttcaccattgtccggcatcctgcggaggcttaatatacaggcgtaaggtcagcagcaatttgtctaataagtgatgagatcagtagctgaagtctctaagctgggccattactaaataccatagccatgttgatctggaaatttatccctctagtgtcttacctcacataagccatttgcccactgtgcaatatagaaaggtgttttcaaaagtatttggccgtagattttcacatccatcataaggttggcattcaataaggaaaaagttctaactccagtattaaattgtacataaatcccaaatgttcttaaagaacactcagggacatgtttgttgcctgggattggtaatgaaaggttggtttttgaaacttgaaatttcaccattggtttttttcctatcatttctgcatatccagcaaaaggaatctcatgttgactcctggcagagttcagtggcttcagtctgtctatctgttctgaggggaaaattgtgttctggatccagtaatcaatttggcaactttaatcgaggttttcaaaattccaaggagggttaataaagaatgataatcagttttatttgctaatagctaagacaaatttgtaataaagtgttttataatacttcaaaagc

SEQ ID NO: 369477 - DNA, 1398 bp, Homo sapiens
acgcagaaagtgccgccgctttggccactcagagcccccgggccgcggtcgtcgtacgcctgaaggcgggtcgtgccggcggccgctctagtctccgcctccgctcaggccggtcctccggggcttctcaatggtttcccggtggcctctcaatggttttcccggcggcccttgcgccgacgccaggagacttccggagcttggtgacgtcacgagcgagcttttctacccaaatacgcggcgggggaataggctcgagggcggtgagcagtgacaattgctaggcggagacagtgcagggaagagagaccttagaaaggatcaggactggcgggaggtatttaactgaaaggaatatctgcttcactgttgcaaccaaaccagatgccttcttccacttcaccagaccaaggagatgacctggagaactgcattttaagattttctgacctggatttaaaagatatgagtcttattaatcccagcagcagtcttaaagcagaattagatggcagtacaaaaaagaaatactcgtttgcaaagaaaaaggcctttgccctttttgtcaaaaccaaagaagttccaacaaaaaggagttttgaatgtaaagaaaaattgtggaaatgctgtcagcagctattcacagaccaaaccagcatccatagacatgtggcaacacaacatgctgatgaaatttatcaccagacagcttctattttaaagcaactggctgtgacattgagcacctcaaagagtctttcgtctgcagatgaaaagaaccctttaaaagagtgccttccacatagccatgacgtgtctgcttggctccctgatataagctgctttaaccctgatgagctgataagtggccagggcagtgaagaaggggaggtgctcctttattactgctaccatgacctggaggatccccaatggatctgtgcctggcagacagctctgtgtcagcacctgcacctcacaggcaagattcgaattgctgcagaaggaatcaatgggacagttggtggaagcaaattggctaccagactttatgtggaagtcatgctttccttcccattgtttaaggatgacctgtgtaaagatgattttaaggttacgagacagtacaatagaaggagtatgctcgtccccattctttcactgagtcaccatatgattttggaccagctagtgctctagacctcagtatcccttcttataaaataagaatgttacagctcatgcaatctgggactccaaatcttggacatattagctcacttgagagaccaccagcctggtcagcagatcactgtgtttttagtaaatctggaattgtaagattaacacttcataccacatgggggaataaagttgttgctctcacaggtgggctgc

SEQ ID NO: 369478 - DNA, 1874 bp, Homo sapiens
  misc_feature (494)..(494): n is a, c, g, or t
cggggtcctcttgtagcggccacgttgatctgcgatacgcgtgtttgcccagtgagtggccccggactgctacgtgggactgcggtgaatgaacccagaaggtggagaggaaccgttctcggtgcacagaggcggctctgcagcccggtgagggcgcctgctgctcccgggcagtgctttccccaagtagtccgatggctgcggctgcgccgaggcgccctactcaggagcaacttggcgaggttcagactcttggagccagaagctacatgacccctaaacgggcacagtgacttttgaagacgtggctgtgaaatttacccaggaggaatggaatctccttagtgaggctcagagatgcctgtaccgtgatgtgactctggagaacctggcacttatgtcctccctgggttgttggtgtggagtggaagatgaggcggcaccttctaagcagagtatttatatacaaagagagactcaggtcaggactcctntgacaggtgtgtctcccaagaaggcccacccctgtgagatgtgtggcccgatcttgggagacattttgcatgtggcagatcatcagggaacacatcacaagcagaaactgcacaggtgtgaggcctgggggaataaattgtatgacagtggaaactttcatcagcaccagaatgagcacattggagagaaaccctacagagggagtgttgaggaggcgttgtttgtgaagaggtgtaagttgcatgtgtcaggggagtcatctgtcttcagtgagagtgggaaggacttttgcccaggtcaggattactccagcaggaggccagtcacactggggagaagtcaaacagcaaaactgagtgtgtgtctccctttcagtgtgggggagctcactatagccatggagattccatgaaacattttagcaccaaacatatactcagtcagcaccagagacttctccctcgagaagaatgttatgtgtgctgtgaatgtgggaaatcctttagcaaatatgttagcttcagtaatcatcagagagttcacagtggaaaaagaccttatgaatgtggagaatgtgagaaatcttttagtcaaaagagcagcctcattcaacatcagcaatttcacactggaggaaaaccttatgggtgtgaagaatgtgggaaatattttagcttagaaggatatcttaggcgccatcaaaaagttcacgctggaaaagggccttatgagtgtggagaatgtgggaaatcttttagttcaaacgtgaaccttaagagtcatcagcgcattcacactggagagagaccttacaagtgtggagaatgtgagaaatcttttagtcggaagcccagccttagttaccatcagcgcattcacactgaagtaagaccttacaagtgtggagaatgtgggaaatcttatatttcaaaggggcaccttaggatccatcagcgcatgcacactggagaaagaccttacaagtgtggagactgtgggaaatcttttaatgaaaaaggacaccttaggagtcatcagcgagttcacactacagaaagaccttataagtgtggggaatgtgggaaatgttttagtcacaagggtaacctcattctacaccagcatggccatactagaaaaaggccttatatgtgttgggaatgtggaaaattatttaagaagaagtctcacctccttgtacaccagagaattcacagtggagagaagccatatgcttgtgaggcttgtcagaaattttttaggcacaagtgccacctcactgcacaccagagagttcacactggagaaaggccatatgaatgcagtgattgtgggaagtcatttacccacagctgtgcattcattgttcataagagagt

SEQ ID NO: 369479 - DNA, 1255 bp, Homo sapiens
  misc_feature (4)..(4): n is a, c, g, or t
tacnactactaaattcgcggccgcgtcgtggcctcaacaatacaatattcatcattatggaagtcctgataattcctgtatctgcatattcatcatatacgtagtgactggatcattgtggatgcccttttaaaagacatgcattacgctgcacgtggtggctcacctgtaatcccaggactttgggaggctgaggccagcagatcacaaggtcaggagttcgagaccagcctggccaacatggtgaaaccccatctctactaaaaatacaaaaattagctgggtgtggtggcatgtgcctgtagtcccagctactcaggaggctgaggcaggagaatcgtttgaacctgggaggcagaggttgccgtgagccaagattatgccactgcactccagcctgggcaacagggtgaggctctgcctcaaaaaaaaagaaaaaaaaagaaaaaaaagacatgagttgcagttacattattctgtctcctccactgcctataaataaagtaattctataaaattataatttcacctgatagcattacaatctgtgatgttatcctacagaattctggatatcagggcatgtgtctgcattgcaagagctgggcaacagacttccctcagccgtaccaagtacaatgcaatatacctcgtaaaagaattttgtcttgttcaaaaaatgccagaaattgtcacaaaaaatgccctgtatccagctgacctatgaacccacaaattttagtatccgtgctacagataaagaccacaaagccctgaaggtcttctctggaggcctctggcagctatgcaaagcagtccacaagtggagaaagctacattctgcattcatactgttccatgagccacaaagtttagctatgccaacaaaagctgtgacccccttcatagtaacaggacctacttatttctgaaccacccatacagtgacaacaaccctcaagattgaagaaggctgaaacaataaggccttcataatagcacaaaccggagaaatgggaggcaagctgttcttaggatcatgacttggagggtagaaaatttgtcaagattgatgtgatacccacaagatctctgaaagacatagtccgtcttttcaagtcaacgtaagaggcctctgggataaaaatgggtaacgtccatggcatgacttatcagacagaaaaaaatgacaaaggaagaagtgctgaagctactcaacaaatccttctgtgactcgatcagaaattaaaagtta

SEQ ID NO: 369480 - DNA, 706 bp, Homo sapiens
acacttgagagttcacacaggagaaaggccttatgaatgcgttgagtgtggaaaatcatttcgccgaagctcttcactcttgcagcatcagagagttcacactagagaaaggccttatgaatgtagtgaatgtgggaaatcctttagcttaagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtgcagtgaatatgggaaatcgtttgctgaagcatcccgtctcgttaaacacaggagagttcatactggagaaaggccttatga

SEQ ID NO: 369481 - DNA, 578 bp, Homo sapiens
  misc_feature (497)..(497): n is a, c, g, or t
  misc_feature (574)..(576): n is a, c, g, or t
ctccagtgtgaactctcttgtgtttagtgagactggagctttcagcaaaagattttccacattcactgcactcataaggcttttctccagtgtgaactcttttgtgttttgtgaaactggagctttcagcgaaagattttccacattcactgcactcataaggcttttctccagtgtgaattcgcttatgaacacagaatgtagagctgtgggtaaatgattttccacaatcattgcattcataaggcctttctccagtgtgaactctctgatgtgcaatgagttggtacttgtttctaaaaaatttctgacaagcttcacaagcatatggcttttctccattgtgaattctctggtgtacaaggaggtgagacttcttcttaaataattttccacattccctacatacataaggtctttctccagtgtggccatgctggtgtagaatgaggttacccttgtgactaaaacatttcccacattccccacacttaaanggtctttctgtagtgtgaactcgctgatgattcctaaggtgtcctttttcattaaaagatttcccacagtcaaaaannnaa

SEQ ID NO: 369482 - DNA, 559 bp, Homo sapiens
cggggtcctcttgtagcggccacgttgatctgcgatacgcgtgtttgcccagtgagtggccccggactgctacgtgggactgcggtgaatgaacccagaaggtggagaggaaccgttctcggtgcacagaggcggctctgcagcccggtgagggcgcctgctgctcccgggcagtgctttccccaagtagtccgatggctgcggctgcgccgaggcgccctactcaggagcaacttggcgaggttcagactcttggagccagaagctacatgacccctaaacgggcacagtgacttttgaagacgtggctgtgaaatttacccaggaggaatggaatctccttagtgaggctcagagatgcctgtaccgtgatgtgactctggagaacctggcacttatgtcctccctggcagggcactgtgacctttgaagatgtggctgtgaacttttcccaggaggagtggtgtcttcttagtgaggctcagaggtgcttgtaccgtgatgtgatgctagagaacctggctctcatatcctcgctgggtaagttgctcacgctcac

SEQ ID NO: 369483 - DNA, 577 bp, Homo sapiens
gttttattattattcaaatcagtctccccgagcatttctggatcagagttttcaaagttaatttggcgggtaggggcttgggaagtggggagtgctgaacggtcaggttggagatggatttatagagggttgaagtgagtttttcatgctgttttctgttgtgggtgggatggcagaactgattgacccagattaccggtctgtgtgttgtcagctgatccatccagtgtaggatctccaaaatacctcaagcactgatcttagcttttacaattgttatgttatcttcaggagcaacttggcgaggttcagactcttggagccagaagctacatgacccctaaacggtaatttctaatcttatagctaaactgttagtcctgcaaaggcaggctggtccccaggcaagaagggagtcttttcaggaaagggctgttatcaattttgtttcagagtgaaaccatgaactgaattccttccctaagttaattcagcctgtgcccaggaatgaacaaggacagcttaaaggttaaaagcaagatggagtcggttaggtctgatttctttcactgtcata

SEQ ID NO: 369484 - DNA, 463 bp, Homo sapiens
ttttttcttaacgtggaatttcagtcttgttgcccaggctatccttgtgttgtctttttaattttcccttagatggtctgccctttccgtgatttctgtgtagaactctgtatcttgagctgtggtactatttttcttttgtcttttaatttaaatcttgttgggagctcttgtgatgaatattaaatacatacattttgggctgggtgtggtgcctctagcctataatcccagcactttgggaggccgaggcaggcgaatcgtgaggtcaggagatcgagaccatcctgcctaacacggtgaaacctcgtctctgcagtctcttgtcttgaattaatacaacttttgttaattctcttatgaagttaatcttcctgcttgtatgtgaattaaatatatgtcaaactttttttgtacaaaagattcatacctctttcctgtttgaaattattttactgtgttt

SEQ ID NO: 369485 - DNA, 170 bp, Homo sapiens
tcagaagccttatgagtgcagtgaatgtgggaaatcttttgctgcaagctcctatctcactagtcacaggagagttcacactggtcagaagccttatgagtgcagtgaatgtgggaaatcttttgctggaatctccagtctcactaatcacaggagagttcacactggag

SEQ ID NO: 369486 - DNA, 8494 bp, Homo sapiens
  misc_feature (4024)..(4024): n is a, c, g, or t
acgtatggtgcagtacattgattgaagtaacatgagagagaaggggtgggtgtagcaaaaacattctcaaggccaagtcatcagcccttacccttaggagggggcagtgattaagaggtggtatgagagcctcgtttctcatttctataagtgctggtaaaggacctgaccccacttccttacctactgcctgcccaggtaactgatgcctacagcatcacaggaattgccaaaatgcagaaaacaaatcctaaattgctctaattccataacacaaaggctggtttttggcttgaaataatcaggcacatatatcatgttctgtcacccagggtggagtgcagtggtgtgatctcggctcactacaaaccccgcctcctgggttcacgccattctccggcctcagcctcccgagtagctgggactacaggtgcccaccaccatgcccggctaattttttgtatttttagtagagacagggtttcaccatgttaaccagcatagtctctatcccctgactgcaagatctgcccgaatcagtgtcccaaagtgctgggattacaggcgtgagccaccgcacccagcccagaagggagtggacctttttatgtcaggacctcagcatggatacctatttgtccacctacttcttgttgctgatggcatttgaccagcaggcccatgaagagacaaaggcaccagtggatgtggtttcaactccgtgttggggaccttgggaggaggatgggcaagggtgggcgtgtgggagaggtgggttgtggtacctcagcagaggggctgcttgtggcttcatctgtcactatcatagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtacacaccaccacgcccagctaatttttgtgtttttagtggagatggggttttaccatgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttggagatcagcctgggcaacatggccagacctcctctctacaaaaagaaaaaagaatgacatgcttcttgtttttgtctgttataaatgaaactgctatatttgaatgcagttgttcatgtaggtatgtttcactatggtaatatggtggtgtgcagtgcctgagtcacgtgatagattaaagtacaactcttttttgagacagagtctcactctgtcacccaggcgggagttaggtggcatgatttcggctcactgcaacctctgcctcccaagttcaactgattcttctgcctcagcctcccgagtagcagggattaccggtgtgcaccaccatgcctggataacttttttttttatttctattagcaatggggtttcaccatgctggccaggcttgttatgaactgacctcaagtgatctgcctgcctcagcttctcaggtgtgacctactgtgcttggcctaatgtacaactttttaagcaatgccaaactatgacttaagaatgaaattattgctcatttgtatatctatctaccatcagtgtccaagaatttctgttctatcttaccaagagggagtatggttagtatttgaaattgtttattattttaataagtggttataacttttgagtcagtggtttatgttttgcattttttttgttttgagacaaagtctcgctctgtctcccaggctagagtaccgtggcacaatctcagctcattgcaacctctgcttcctgggctcaagcactctgcccacctcagcctccagagtagctggaaatacaggtatgcaccaccacaactggataacttttgtattttctgtagagagggttttacctttttgcccagtctgatcgcgaactcctgggctcaggcgatccacttgcctaggctccaaaagtgcttggtctacaggggtgaggcaccctgcctggcctcacctgtaggcttgttttttaaaatgaattttatctatttcccatttcattaatatatttaaaaataatgaaataacaaagacgtatgttggacttcattcattcttcagtgatgtcactttgctgcaaggaatatttggttttcttttttttttttttttccagatggagtctagctctgtctcctaagctacagtgaagtggcatgatctcggcccactgcaacctccacctcctgtgttcaagcgattctgcctcagcctcctgagtagctgggactacnggcatgtgccattatacctggctaattttatttatttattttagtagagatggggtttcaccatgttacccaggctgctctctaccttctgagctcaagtgatccacctgcctcggcctcccaaagtgctgggattacaggtgtcagccactgtacctggctgaatacttggttttcagtaccacaagaactatgagctggttatccacttcatgtggaatcataagcgtcccaaagtgacaatacatatagattgccaggcagtgaaacagttaagatgccaccatagctttcttttcaacatctttctaagattaccttactatttcttttgttccaagtttgtacttcctcacagttctcacatatggaaaggatacacactttgtagaaacaagaactttatgttatccaagttctaggatagccatgagctccaattatctcagagctctgagtcctctactcaatacccattgagatttatgtgttctgaggcttttgtcttctagctacttacttcattctccatgggtaacgtcattcatccacattaactaatttcctcactccaagctcttttctagagataatctccagtccctgtgcagaaactgtcattgcactttctgctgaaatggcagtttcttctcagcaaggtgagattatggaatccagaatcttttttcaggggtcacatgcccatttccccacttgcatgaatgtcgacactgcagccacagttttggccgtaaatgtgaatttggcaagtaaccactgttcccagggaaatgtcccaatcagaagaagattatctgggacactgatactgacagggagatgggacattctgagggacccggaggcagggtgccacctcctcaacttccctgagggctgcctagaatctgtttcctctcactctgaattattcttcctcttatggctgaccaaaaacatggaacctcacaaagtccactgtaacagctttatatttgtgaagtgaagaacatgaagacagtttcaagcaaagttattgagtggacactttgtgttttttttgagaagtctcactctttcacccaggctggagtgcagtggcacgatctcggctcactgcaactccacctcccgggttcacgccattctcttgcctcagcctcctgagtagctgggaccacaagcgcccaccacgtcagcttaatttttttgttttgtttcttgagacagagtcttgctctcttgcccaggttggagtgccgtgtcgcaatctcagctcactgcaacttctacctcctggattcaagcacttctccttgcctcagccacctctttagctgggattacaggtgcgtgccaccacacccagctaattaccttgtattacagcatgttatataagcacatacaggcacatacatgaaatagtgatacttcattctcagtaatatcttcatccttctcactggaaagatctttgatgatttttaatcaacataggagtttcaatgatatctagaagtttaaaagggctcgttcaaacaaattatgaccacacacactgaagagtatgtttgtctcttgtggtgtaaatttttttttattacaccaaattatgttcacacaaaacctttgtaatcagggggaattaaagagccttcctggaaaatggaggttgcaatcagccgagatggtgccatcgcactctagcctggggaatagagtgagatcctgcctcaaaaaaaacaaaaaaattctttattttctccataaactacagtttatataagcaaaagtttcagtactaagcaattttagtctctgcagtctcttgtcttgaattaatacaacttttgttaattctcttatgaagttaatcttcctgcttgtatgtgaattaaatatatgtcaaactttttttgtacaaaagattcatacctctttcctgtttgaaattattttactgtgtttcatcaatctaatgtttatttttattacaccagtaatttcctcattgtgttgaatcttacagtggcttataaatctacatgtacctagaaatgtttagccagtccatgtatatttgatgtggcacattttttcctttgaatcacatactctaagagaagtaacttcctcttgctaacctctactttccctaagtgttgaattaatcctctttagatgattataattctcttttcaatagctagaaagaatctataaggaactttcctggctgggtgtggtggctcatgcctgtaatcccagcacttcaggaggccgaggtgggtggatcacgaggtcaggagttccagaccagcctgaccaacatggttaaaccatgtctttactaaaaatgcaaaaattagcacctgtaatcccagctactcaggaggctgaggcatagaattgcttgaacctggcaggcagaggtggtgagccgagatcacggcactgcactccagcctgggtgacaagagcaagactccgtctcaaaataaataaataaaaataaaaaataaacatgatgatcacagatgcagtcacattttctgagttcttgtctctctgccagtgccacccagatagcctcacaaaactttgacccagccactgttagtgtcgccaccgcccataaaggagctgagcccagcaggggcactgcctggggccctgtagccaaaaggctacagcaggagctgatgaccctcatgatgcctggtgacaaaagaatttctgcctaccctgaaagccttatcaaatggacaccatccatgaagcagctggcacagtgtatgaagatctgaggtataagctcttgctggagttcctcaatgactacccacctttacgatgcacccacagtgaagttcctcacaccctgctaccaccctaacgtggacacccagggtaacatatgcctggacatcctgaaggagaagtggtctgccccgtatgatatcaggaccatcctgctctctatccagtgcctgctaggacaactcaacattgatagccctttgaacacacatgctaccaagctctgggaaaaccccatagctttaagaagtacctgcaagggtcaggcgcagtggctcacacctgtaatcccagcactttgggaggccgaggtgggtggatggatcacctgacgtagagagtccaaggcctgacaaacatggagaaatgtcatccctatttaaaaaaataaaaaaattagccaagtgtggtggcgcatgcctgtaatcccagctactcgggaggctgaggcaggagaatcacttgaacctgggaggtggaggttgcagtgagccgagatctcgctattgcactccagcctgggcaacaagagtgaaactctgcctcaaaaaaaaataaaataaaataaaaataaaaataaggaagtacctgcaagaaagctactcaaagtaggtcaccagccaggagctctgacccaggctgcccagcctatccttgtgttgtctttttaattttcccttagatggtctgccctttccgtgatttctgtgtagaactctgtatcttgagctgtggtactatttttcttttgtcttttaatttaaatcttgttgggagctcttgtgatgaatattaaatacatacattttgggctgggtgtggtgcctctagcctataatcccagcactttgggaggccgaggcaggcgaatcgtgaggtcaggagatcgagaccatcctgcctaacacggtgaaacctcgtctctactaaaaatacaaaaaaattagccgggcgtggtggcgggtgcctatagtcccagctgctcgggaggctgaggcaggagaatggcatgaacccgggaggtggagcttgcagtgagctgagattgcaccactgcactccaggctgggcacagagcaagactccatctcaaaaaaaaaaaaaaaaaaaagacaaaaagaaaacattttggtcattaaaaaacaaaaaaaaaatgatacgagagagcacccagggattataagaggaaacactttattacatcactcatctaacattccagaaaatggaaagtactctactgtacagcaaagtaaatcattggttgtctggagaacagaaagaaagcctttataaaaaggttccaagtaaatataaaggtgttaagttcattattgtgactatgttaatggtttcatgggattatatgaaactcaagatttatcacatgctacagcttaaatatgcatagcttactgaatgtcatttataactcatcacagctttaaaatatacttcagactggcagcagtggctcacacctgtattcccaccactctgggaggctgaggcaggcatatcacctgaggtcaggagtccaagatcagcctggccaacatggcaaaactccgtctctactaaaaatacaaaacttggccgggcatggtggcacatgcttccagtcccacctacatgggaggctgagcc

SEQ ID NO: 369487 - DNA, 8189 bp, Homo sapiens
  misc_feature (3719)..(3719): n is a, c, g, or t
gagatggtgtctcgctctgttggccagggtggagtgcagtggtgtgatctcggctcactacaaaccccgcctcctgggttcacgccattctccggcctcagcctcccgagtagctgggactacaggtgcccaccaccatgcccggctaattttttgtatttttagtagagacagggtttcaccatgttaaccagcatagtctctatcccctgactgcaagatctgcccgaatcagtgtcccaaagtgctgggattacaggcgtgagccaccgcacccagcccagaagggagtggacctttttatgtcaggacctcagcatggatacctatttgtccacctacttcttgttgctgatggcatttgaccagcaggcccatgaagagacaaaggcaccagtggatgtggtttcaactccgtgttggggaccttgggaggaggatgggcaagggtgggcgtgtgggagaggtgggttgtggtacctcagcagaggggctgcttgtggcttcatctgtcactatcatagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtacacaccaccacgcccagctaatttttgtgtttttagtggagatggggttttaccatgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttggagatcagcctgggcaacatggccagacctcctctctacaaaaagaaaaaagaatgacatgcttcttgtttttgtctgttataaatgaaactgctatatttgaatgcagttgttcatgtaggtatgtttcactatggtaatatggtggtgtgcagtgcctgagtcacgtgatagattaaagtacaactcttttttgagacagagtctcactctgtcacccaggcgggagttaggtggcatgatttcggctcactgcaacctctgcctcccaagttcaactgattcttctgcctcagcctcccgagtagcagggattaccggtgtgcaccaccatgcctggataacttttttttttatttctattagcaatggggtttcaccatgctggccaggcttgttatgaactgacctcaagtgatctgcctgcctcagcttctcaggtgtgacctactgtgcttggcctaatgtacaactttttaagcaatgccaaactatgacttaagaatgaaattattgctcatttgtatatctatctaccatcagtgtccaagaatttctgttctatcttaccaagagggagtatggttagtatttgaaattgtttattattttaataagtggttataacttttgagtcagtggtttatgttttgcattttttttgttttgagacaaagtctcgctctgtctcccaggctagagtaccgtggcacaatctcagctcattgcaacctctgcttcctgggctcaagcactctgcccacctcagcctccagagtagctggaaatacaggtatgcaccaccacaactggataacttttgtattttctgtagagagggttttacctttttgcccagtctgatcgcgaactcctgggctcaggcgatccacttgcctaggctccaaaagtgcttggtctacaggggtgaggcaccctgcctggcctcacctgtaggcttgttttttaaaatgaattttatctatttcccatttcattaatatatttaaaaataatgaaataacaaagacgtatgttggacttcattcattcttcagtgatgtcactttgctgcaaggaatatttggttttcttttttttttttttttccagatggagtctagctctgtctcctaagctacagtgaagtggcatgatctcggcccactgcaacctccacctcctgtgttcaagcgattctgcctcagcctcctgagtagctgggactacnggcatgtgccattatacctggctaattttatttatttattttagtagagatggggtttcaccatgttacccaggctgctctctaccttctgagctcaagtgatccacctgcctcggcctcccaaagtgctgggattacaggtgtcagccactgtacctggctgaatacttggttttcagtaccacaagaactatgagctggttatccacttcatgtggaatcataagcgtcccaaagtgacaatacatatagattgccaggcagtgaaacagttaagatgccaccatagctttcttttcaacatctttctaagattaccttactatttcttttgttccaagtttgtacttcctcacagttctcacatatggaaaggatacacactttgtagaaacaagaactttatgttatccaagttctaggatagccatgagctccaattatctcagagctctgagtcctctactcaatacccattgagatttatgtgttctgaggcttttgtcttctagctacttacttcattctccatgggtaacgtcattcatccacattaactaatttcctcactccaagctcttttctagagataatctccagtccctgtgcagaaactgtcattgcactttctgctgaaatggcagtttcttctcagcaaggtgagattatggaatccagaatcttttttcaggggtcacatgcccatttccccacttgcatgaatgtcgacactgcagccacagttttggccgtaaatgtgaatttggcaagtaaccactgttcccagggaaatgtcccaatcagaagaagattatctgggacactgatactgacagggagatgggacattctgagggacccggaggcagggtgccacctcctcaacttccctgagggctgcctagaatctgtttcctctcactctgaattattcttcctcttatggctgaccaaaaacatggaacctcacaaagtccactgtaacagctttatatttgtgaagtgaagaacatgaagacagtttcaagcaaagttattgagtggacactttgtgttttttttgagaagtctcactctttcacccaggctggagtgcagtggcacgatctcggctcactgcaactccacctcccgggttcacgccattctcttgcctcagcctcctgagtagctgggaccacaagcgcccaccacgtcagcttaatttttttgttttgtttcttgagacagagtcttgctctcttgcccaggttggagtgccgtgtcgcaatctcagctcactgcaacttctacctcctggattcaagcacttctccttgcctcagccacctctttagctgggattacaggtgcgtgccaccacacccagctaattaccttgtattacagcatgttatataagcacatacaggcacatacatgaaatagtgatacttcattctcagtaatatcttcatccttctcactggaaagatctttgatgatttttaatcaacataggagtttcaatgatatctagaagtttaaaagggctcgttcaaacaaattatgaccacacacactgaagagtatgtttgtctcttgtggtgtaaatttttttttattacaccaaattatgttcacacaaaacctttgtaatcagggggaattaaagagccttcctggaaaatggaggttgcaatcagccgagatggtgccatcgcactctagcctggggaatagagtgagatcctgcctcaaaaaaaacaaaaaaattctttattttctccataaactacagtttatataagcaaaagtttcagtactaagcaattttagtctctgcagtctcttgtcttgaattaatacaacttttgttaattctcttatgaagttaatcttcctgcttgtatgtgaattaaatatatgtcaaactttttttgtacaaaagattcatacctctttcctgtttgaaattattttactgtgtttcatcaatctaatgtttatttttattacaccagtaatttcctcattgtgttgaatcttacagtggcttataaatctacatgtacctagaaatgtttagccagtccatgtatatttgatgtggcacattttttcctttgaatcacatactctaagagaagtaacttcctcttgctaacctctactttccctaagtgttgaattaatcctctttagatgattataattctcttttcaatagctagaaagaatctataaggaactttcctggctgggtgtggtggctcatgcctgtaatcccagcacttcaggaggccgaggtgggtggatcacgaggtcaggagttccagaccagcctgaccaacatggttaaaccatgtctttactaaaaatgcaaaaattagcacctgtaatcccagctactcaggaggctgaggcatagaattgcttgaacctggcaggcagaggtggtgagccgagatcacggcactgcactccagcctgggtgacaagagcaagactccgtctcaaaataaataaataaaaataaaaaataaacatgatgatcacagatgcagtcacattttctgagttcttgtctctctgccagtgccacccagatagcctcacaaaactttgacccagccactgttagtgtcgccaccgcccataaaggagctgagcccagcaggggcactgcctggggccctgtagccaaaaggctacagcaggagctgatgaccctcatgatgcctggtgacaaaagaatttctgcctaccctgaaagccttatcaaatggacaccatccatgaagcagctggcacagtgtatgaagatctgaggtataagctcttgctggagttcctcaatgactacccacctttacgatgcacccacagtgaagttcctcacaccctgctaccaccctaacgtggacacccagggtaacatatgcctggacatcctgaaggagaagtggtctgccccgtatgatatcaggaccatcctgctctctatccagtgcctgctaggacaactcaacattgatagccctttgaacacacatgctaccaagctctgggaaaaccccatagctttaagaagtacctgcaagggtcaggcgcagtggctcacacctgtaatcccagcactttgggaggccgaggtgggtggatggatcacctgacgtagagagtccaaggcctgacaaacatggagaaatgtcatccctatttaaaaaaataaaaaaattagccaagtgtggtggcgcatgcctgtaatcccagctactcgggaggctgaggcaggagaatcacttgaacctgggaggtggaggttgcagtgagccgagatctcgctattgcactccagcctgggcaacaagagtgaaactctgcctcaaaaaaaaataaaataaaataaaaataaaaataaggaagtacctgcaagaaagctactcaaagtaggtcaccagccaggagctctgacccaggctgcccagcctatccttgtgttgtctttttaattttcccttagatggtctgccctttccgtgatttctgtgtagaactctgtatcttgagctgtggtactatttttcttttgtcttttaatttaaatcttgttgggagctcttgtgatgaatattaaatacatacattttgggctgggtgtggtgcctctagcctataatcccagcactttgggaggccgaggcaggcgaatcgtgaggtcaggagatcgagaccatcctgcctaacacggtgaaacctcgtctctactaaaaatacaaaaaaattagccgggcgtggtggcgggtgcctatagtcccagctgctcgggaggctgaggcaggagaatggcatgaacccgggaggtggagcttgcagtgagctgagattgcaccactgcactccaggctgggcacagagcaagactccatctcaaaaaaaaaaaaaaaaaaaagacaaaaagaaaacattttggtcattaaaaaacaaaaaaaaaatgatacgagagagcacccagggattataagaggaaacactttattacatcactcatctaacattccagaaaatggaaagtactctactgtacagcaaagtaaatcattggttgtctggagaacagaaagaaagcctttataaaaaggttccaagtaaatataaaggtgttaagttcattattgtgactatgttaatggtttcatgggattatatgaaactcaagatttatcacatgctacagcttaaatatgcatagcttactgaatgtcatttataactcatcacagctttaaaatatacttcagactggcagcagtggctcacacctgtattcccaccactctgggaggctgaggcaggcatatcacctgaggtcaggagtccaagatcagcctggccaacatggcaaaactccgtctctactaaaaatacaaaacttggccgggcatggtggcacatgcttccagtcccacctacatgggaggctgagcc

SEQ ID NO: 369488 - DNA, 8284 bp, Homo sapiens
  misc_feature (3814)..(3814): n is a, c, g, or t
tttttttggtttggttttgtttgagatggagtctcactccagcctggcagcagagggagactccatctcaaacaaacaaacaaacaaaaaaagatactttaagttgtttaaaggccagagagaggccagtggtgtgtggcagtcagctggggatggacatggaatgtacctggaagtctaaagaatgaggtgcgttcagagagggtatctctgctgtgctgaaggtgccacattgggcttcccatgacctcggccatactagggaaagtgcctgtcaggagtgggtggactttatgtcacagccactgcacagatacctatttgttcaactaactattgttggtggctgtaccccatgaccagtgggcctagtttctcctatgtttgaggaccttgagaggaggatgtgcgagagtagatgtgtgggagagatggattgtgatacctcagcataggggtggtttgtggtttcatctgtcaacatcataacagggcacagtgacttttgaagacgtggctgtgaaatttacccaggaggaatggaatctccttagtgaggctcagagatgcctgtaccgtgatgtgactctggagaacctggcacttatgtcctccctggcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtacacaccaccacgcccagctaatttttgtgtttttagtggagatggggttttaccatgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttggagatcagcctgggcaacatggccagacctcctctctacaaaaagaaaaaagaatgacatgcttcttgtttttgtctgttataaatgaaactgctatatttgaatgcagttgttcatgtaggtatgtttcactatggtaatatggtggtgtgcagtgcctgagtcacgtgatagattaaagtacaactcttttttgagacagagtctcactctgtcacccaggcgggagttaggtggcatgatttcggctcactgcaacctctgcctcccaagttcaactgattcttctgcctcagcctcccgagtagcagggattaccggtgtgcaccaccatgcctggataacttttttttttatttctattagcaatggggtttcaccatgctggccaggcttgttatgaactgacctcaagtgatctgcctgcctcagcttctcaggtgtgacctactgtgcttggcctaatgtacaactttttaagcaatgccaaactatgacttaagaatgaaattattgctcatttgtatatctatctaccatcagtgtccaagaatttctgttctatcttaccaagagggagtatggttagtatttgaaattgtttattattttaataagtggttataacttttgagtcagtggtttatgttttgcattttttttgttttgagacaaagtctcgctctgtctcccaggctagagtaccgtggcacaatctcagctcattgcaacctctgcttcctgggctcaagcactctgcccacctcagcctccagagtagctggaaatacaggtatgcaccaccacaactggataacttttgtattttctgtagagagggttttacctttttgcccagtctgatcgcgaactcctgggctcaggcgatccacttgcctaggctccaaaagtgcttggtctacaggggtgaggcaccctgcctggcctcacctgtaggcttgttttttaaaatgaattttatctatttcccatttcattaatatatttaaaaataatgaaataacaaagacgtatgttggacttcattcattcttcagtgatgtcactttgctgcaaggaatatttggttttcttttttttttttttttccagatggagtctagctctgtctcctaagctacagtgaagtggcatgatctcggcccactgcaacctccacctcctgtgttcaagcgattctgcctcagcctcctgagtagctgggactacnggcatgtgccattatacctggctaattttatttatttattttagtagagatggggtttcaccatgttacccaggctgctctctaccttctgagctcaagtgatccacctgcctcggcctcccaaagtgctgggattacaggtgtcagccactgtacctggctgaatacttggttttcagtaccacaagaactatgagctggttatccacttcatgtggaatcataagcgtcccaaagtgacaatacatatagattgccaggcagtgaaacagttaagatgccaccatagctttcttttcaacatctttctaagattaccttactatttcttttgttccaagtttgtacttcctcacagttctcacatatggaaaggatacacactttgtagaaacaagaactttatgttatccaagttctaggatagccatgagctccaattatctcagagctctgagtcctctactcaatacccattgagatttatgtgttctgaggcttttgtcttctagctacttacttcattctccatgggtaacgtcattcatccacattaactaatttcctcactccaagctcttttctagagataatctccagtccctgtgcagaaactgtcattgcactttctgctgaaatggcagtttcttctcagcaaggtgagattatggaatccagaatcttttttcaggggtcacatgcccatttccccacttgcatgaatgtcgacactgcagccacagttttggccgtaaatgtgaatttggcaagtaaccactgttcccagggaaatgtcccaatcagaagaagattatctgggacactgatactgacagggagatgggacattctgagggacccggaggcagggtgccacctcctcaacttccctgagggctgcctagaatctgtttcctctcactctgaattattcttcctcttatggctgaccaaaaacatggaacctcacaaagtccactgtaacagctttatatttgtgaagtgaagaacatgaagacagtttcaagcaaagttattgagtggacactttgtgttttttttgagaagtctcactctttcacccaggctggagtgcagtggcacgatctcggctcactgcaactccacctcccgggttcacgccattctcttgcctcagcctcctgagtagctgggaccacaagcgcccaccacgtcagcttaatttttttgttttgtttcttgagacagagtcttgctctcttgcccaggttggagtgccgtgtcgcaatctcagctcactgcaacttctacctcctggattcaagcacttctccttgcctcagccacctctttagctgggattacaggtgcgtgccaccacacccagctaattaccttgtattacagcatgttatataagcacatacaggcacatacatgaaatagtgatacttcattctcagtaatatcttcatccttctcactggaaagatctttgatgatttttaatcaacataggagtttcaatgatatctagaagtttaaaagggctcgttcaaacaaattatgaccacacacactgaagagtatgtttgtctcttgtggtgtaaatttttttttattacaccaaattatgttcacacaaaacctttgtaatcagggggaattaaagagccttcctggaaaatggaggttgcaatcagccgagatggtgccatcgcactctagcctggggaatagagtgagatcctgcctcaaaaaaaacaaaaaaattctttattttctccataaactacagtttatataagcaaaagtttcagtactaagcaattttagtctctgcagtctcttgtcttgaattaatacaacttttgttaattctcttatgaagttaatcttcctgcttgtatgtgaattaaatatatgtcaaactttttttgtacaaaagattcatacctctttcctgtttgaaattattttactgtgtttcatcaatctaatgtttatttttattacaccagtaatttcctcattgtgttgaatcttacagtggcttataaatctacatgtacctagaaatgtttagccagtccatgtatatttgatgtggcacattttttcctttgaatcacatactctaagagaagtaacttcctcttgctaacctctactttccctaagtgttgaattaatcctctttagatgattataattctcttttcaatagctagaaagaatctataaggaactttcctggctgggtgtggtggctcatgcctgtaatcccagcacttcaggaggccgaggtgggtggatcacgaggtcaggagttccagaccagcctgaccaacatggttaaaccatgtctttactaaaaatgcaaaaattagcacctgtaatcccagctactcaggaggctgaggcatagaattgcttgaacctggcaggcagaggtggtgagccgagatcacggcactgcactccagcctgggtgacaagagcaagactccgtctcaaaataaataaataaaaataaaaaataaacatgatgatcacagatgcagtcacattttctgagttcttgtctctctgccagtgccacccagatagcctcacaaaactttgacccagccactgttagtgtcgccaccgcccataaaggagctgagcccagcaggggcactgcctggggccctgtagccaaaaggctacagcaggagctgatgaccctcatgatgcctggtgacaaaagaatttctgcctaccctgaaagccttatcaaatggacaccatccatgaagcagctggcacagtgtatgaagatctgaggtataagctcttgctggagttcctcaatgactacccacctttacgatgcacccacagtgaagttcctcacaccctgctaccaccctaacgtggacacccagggtaacatatgcctggacatcctgaaggagaagtggtctgccccgtatgatatcaggaccatcctgctctctatccagtgcctgctaggacaactcaacattgatagccctttgaacacacatgctaccaagctctgggaaaaccccatagctttaagaagtacctgcaagggtcaggcgcagtggctcacacctgtaatcccagcactttgggaggccgaggtgggtggatggatcacctgacgtagagagtccaaggcctgacaaacatggagaaatgtcatccctatttaaaaaaataaaaaaattagccaagtgtggtggcgcatgcctgtaatcccagctactcgggaggctgaggcaggagaatcacttgaacctgggaggtggaggttgcagtgagccgagatctcgctattgcactccagcctgggcaacaagagtgaaactctgcctcaaaaaaaaataaaataaaataaaaataaaaataaggaagtacctgcaagaaagctactcaaagtaggtcaccagccaggagctctgacccaggctgcccagcctatccttgtgttgtctttttaattttcccttagatggtctgccctttccgtgatttctgtgtagaactctgtatcttgagctgtggtactatttttcttttgtcttttaatttaaatcttgttgggagctcttgtgatgaatattaaatacatacattttgggctgggtgtggtgcctctagcctataatcccagcactttgggaggccgaggcaggcgaatcgtgaggtcaggagatcgagaccatcctgcctaacacggtgaaacctcgtctctactaaaaatacaaaaaaattagccgggcgtggtggcgggtgcctatagtcccagctgctcgggaggctgaggcaggagaatggcatgaacccgggaggtggagcttgcagtgagctgagattgcaccactgcactccaggctgggcacagagcaagactccatctcaaaaaaaaaaaaaaaaaaaagacaaaaagaaaacattttggtcattaaaaaacaaaaaaaaaatgatacgagagagcacccagggattataagaggaaacactttattacatcactcatctaacattccagaaaatggaaagtactctactgtacagcaaagtaaatcattggttgtctggagaacagaaagaaagcctttataaaaaggttccaagtaaatataaaggtgttaagttcattattgtgactatgttaatggtttcatgggattatatgaaactcaagatttatcacatgctacagcttaaatatgcatagcttactgaatgtcatttataactcatcacagctttaaaatatacttcagactggcagcagtggctcacacctgtattcccaccactctgggaggctgaggcaggcatatcacctgaggtcaggagtccaagatcagcctggccaacatggcaaaactccgtctctactaaaaatacaaaacttggccgggcatggtggcacatgcttccagtcccacctacatgggaggctgagcc

SEQ ID NO: 369489 - DNA, 7900 bp, Homo sapiens
  misc_feature (3430)..(3430): n is a, c, g, or t
ggccgagacttccggggtctctagtagcggctgtgtatcggcgatgcgggtgtttccccagtttgtggcccctgagtgctgggtgggaccgcggtgactgaacctagaaggtggagaggaatcgtcctcggtgcccagaggcggctctgcagccccgtgacggcgaccactgctcccgggccgtgcttccccaagtagtccgatggcagcggctgtgccgaggcgcccaactcagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtacacaccaccacgcccagctaatttttgtgtttttagtggagatggggttttaccatgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttggagatcagcctgggcaacatggccagacctcctctctacaaaaagaaaaaagaatgacatgcttcttgtttttgtctgttataaatgaaactgctatatttgaatgcagttgttcatgtaggtatgtttcactatggtaatatggtggtgtgcagtgcctgagtcacgtgatagattaaagtacaactcttttttgagacagagtctcactctgtcacccaggcgggagttaggtggcatgatttcggctcactgcaacctctgcctcccaagttcaactgattcttctgcctcagcctcccgagtagcagggattaccggtgtgcaccaccatgcctggataacttttttttttatttctattagcaatggggtttcaccatgctggccaggcttgttatgaactgacctcaagtgatctgcctgcctcagcttctcaggtgtgacctactgtgcttggcctaatgtacaactttttaagcaatgccaaactatgacttaagaatgaaattattgctcatttgtatatctatctaccatcagtgtccaagaatttctgttctatcttaccaagagggagtatggttagtatttgaaattgtttattattttaataagtggttataacttttgagtcagtggtttatgttttgcattttttttgttttgagacaaagtctcgctctgtctcccaggctagagtaccgtggcacaatctcagctcattgcaacctctgcttcctgggctcaagcactctgcccacctcagcctccagagtagctggaaatacaggtatgcaccaccacaactggataacttttgtattttctgtagagagggttttacctttttgcccagtctgatcgcgaactcctgggctcaggcgatccacttgcctaggctccaaaagtgcttggtctacaggggtgaggcaccctgcctggcctcacctgtaggcttgttttttaaaatgaattttatctatttcccatttcattaatatatttaaaaataatgaaataacaaagacgtatgttggacttcattcattcttcagtgatgtcactttgctgcaaggaatatttggttttcttttttttttttttttccagatggagtctagctctgtctcctaagctacagtgaagtggcatgatctcggcccactgcaacctccacctcctgtgttcaagcgattctgcctcagcctcctgagtagctgggactacnggcatgtgccattatacctggctaattttatttatttattttagtagagatggggtttcaccatgttacccaggctgctctctaccttctgagctcaagtgatccacctgcctcggcctcccaaagtgctgggattacaggtgtcagccactgtacctggctgaatacttggttttcagtaccacaagaactatgagctggttatccacttcatgtggaatcataagcgtcccaaagtgacaatacatatagattgccaggcagtgaaacagttaagatgccaccatagctttcttttcaacatctttctaagattaccttactatttcttttgttccaagtttgtacttcctcacagttctcacatatggaaaggatacacactttgtagaaacaagaactttatgttatccaagttctaggatagccatgagctccaattatctcagagctctgagtcctctactcaatacccattgagatttatgtgttctgaggcttttgtcttctagctacttacttcattctccatgggtaacgtcattcatccacattaactaatttcctcactccaagctcttttctagagataatctccagtccctgtgcagaaactgtcattgcactttctgctgaaatggcagtttcttctcagcaaggtgagattatggaatccagaatcttttttcaggggtcacatgcccatttccccacttgcatgaatgtcgacactgcagccacagttttggccgtaaatgtgaatttggcaagtaaccactgttcccagggaaatgtcccaatcagaagaagattatctgggacactgatactgacagggagatgggacattctgagggacccggaggcagggtgccacctcctcaacttccctgagggctgcctagaatctgtttcctctcactctgaattattcttcctcttatggctgaccaaaaacatggaacctcacaaagtccactgtaacagctttatatttgtgaagtgaagaacatgaagacagtttcaagcaaagttattgagtggacactttgtgttttttttgagaagtctcactctttcacccaggctggagtgcagtggcacgatctcggctcactgcaactccacctcccgggttcacgccattctcttgcctcagcctcctgagtagctgggaccacaagcgcccaccacgtcagcttaatttttttgttttgtttcttgagacagagtcttgctctcttgcccaggttggagtgccgtgtcgcaatctcagctcactgcaacttctacctcctggattcaagcacttctccttgcctcagccacctctttagctgggattacaggtgcgtgccaccacacccagctaattaccttgtattacagcatgttatataagcacatacaggcacatacatgaaatagtgatacttcattctcagtaatatcttcatccttctcactggaaagatctttgatgatttttaatcaacataggagtttcaatgatatctagaagtttaaaagggctcgttcaaacaaattatgaccacacacactgaagagtatgtttgtctcttgtggtgtaaatttttttttattacaccaaattatgttcacacaaaacctttgtaatcagggggaattaaagagccttcctggaaaatggaggttgcaatcagccgagatggtgccatcgcactctagcctggggaatagagtgagatcctgcctcaaaaaaaacaaaaaaattctttattttctccataaactacagtttatataagcaaaagtttcagtactaagcaattttagtctctgcagtctcttgtcttgaattaatacaacttttgttaattctcttatgaagttaatcttcctgcttgtatgtgaattaaatatatgtcaaactttttttgtacaaaagattcatacctctttcctgtttgaaattattttactgtgtttcatcaatctaatgtttatttttattacaccagtaatttcctcattgtgttgaatcttacagtggcttataaatctacatgtacctagaaatgtttagccagtccatgtatatttgatgtggcacattttttcctttgaatcacatactctaagagaagtaacttcctcttgctaacctctactttccctaagtgttgaattaatcctctttagatgattataattctcttttcaatagctagaaagaatctataaggaactttcctggctgggtgtggtggctcatgcctgtaatcccagcacttcaggaggccgaggtgggtggatcacgaggtcaggagttccagaccagcctgaccaacatggttaaaccatgtctttactaaaaatgcaaaaattagcacctgtaatcccagctactcaggaggctgaggcatagaattgcttgaacctggcaggcagaggtggtgagccgagatcacggcactgcactccagcctgggtgacaagagcaagactccgtctcaaaataaataaataaaaataaaaaataaacatgatgatcacagatgcagtcacattttctgagttcttgtctctctgccagtgccacccagatagcctcacaaaactttgacccagccactgttagtgtcgccaccgcccataaaggagctgagcccagcaggggcactgcctggggccctgtagccaaaaggctacagcaggagctgatgaccctcatgatgcctggtgacaaaagaatttctgcctaccctgaaagccttatcaaatggacaccatccatgaagcagctggcacagtgtatgaagatctgaggtataagctcttgctggagttcctcaatgactacccacctttacgatgcacccacagtgaagttcctcacaccctgctaccaccctaacgtggacacccagggtaacatatgcctggacatcctgaaggagaagtggtctgccccgtatgatatcaggaccatcctgctctctatccagtgcctgctaggacaactcaacattgatagccctttgaacacacatgctaccaagctctgggaaaaccccatagctttaagaagtacctgcaagggtcaggcgcagtggctcacacctgtaatcccagcactttgggaggccgaggtgggtggatggatcacctgacgtagagagtccaaggcctgacaaacatggagaaatgtcatccctatttaaaaaaataaaaaaattagccaagtgtggtggcgcatgcctgtaatcccagctactcgggaggctgaggcaggagaatcacttgaacctgggaggtggaggttgcagtgagccgagatctcgctattgcactccagcctgggcaacaagagtgaaactctgcctcaaaaaaaaataaaataaaataaaaataaaaataaggaagtacctgcaagaaagctactcaaagtaggtcaccagccaggagctctgacccaggctgcccagcctatccttgtgttgtctttttaattttcccttagatggtctgccctttccgtgatttctgtgtagaactctgtatcttgagctgtggtactatttttcttttgtcttttaatttaaatcttgttgggagctcttgtgatgaatattaaatacatacattttgggctgggtgtggtgcctctagcctataatcccagcactttgggaggccgaggcaggcgaatcgtgaggtcaggagatcgagaccatcctgcctaacacggtgaaacctcgtctctactaaaaatacaaaaaaattagccgggcgtggtggcgggtgcctatagtcccagctgctcgggaggctgaggcaggagaatggcatgaacccgggaggtggagcttgcagtgagctgagattgcaccactgcactccaggctgggcacagagcaagactccatctcaaaaaaaaaaaaaaaaaaaagacaaaaagaaaacattttggtcattaaaaaacaaaaaaaaaatgatacgagagagcacccagggattataagaggaaacactttattacatcactcatctaacattccagaaaatggaaagtactctactgtacagcaaagtaaatcattggttgtctggagaacagaaagaaagcctttataaaaaggttccaagtaaatataaaggtgttaagttcattattgtgactatgttaatggtttcatgggattatatgaaactcaagatttatcacatgctacagcttaaatatgcatagcttactgaatgtcatttataactcatcacagctttaaaatatacttcagactggcagcagtggctcacacctgtattcccaccactctgggaggctgaggcaggcatatcacctgaggtcaggagtccaagatcagcctggccaacatggcaaaactccgtctctactaaaaatacaaaacttggccgggcatggtggcacatgcttccagtcccacctacatgggaggctgagcc

SEQ ID NO: 369490 - DNA, 8139 bp, Homo sapiens
  misc_feature (3669)..(3669): n is a, c, g, or t
gttttattattattcaaatcagtctccccgagcatttctggatcagagttttcaaagttaatttggcgggtaggggcttgggaagtggggagtgctgaacggtcaggttggagatggatttatagagggttgaagtgagtttttcatgctgttttctgttgtgggtgggatggcagaactgattgacccagattaccggtctgtgtgttgtcagctgatccatccagtgtaggatctccaaaatacctcaagcactgatcttagcttttacaattgttatgttatcttcaggagcaacttggcgaggttcagactcttggagccagaagctacatgacccctaaacgggcacagtgacttttgaagacgtggctgtgaaatttacccaggaggaatggaatctccttagtgaggctcagagatgcctgtaccgtgatgtgactctggagaacctggcacttatgtcctccctggcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtacacaccaccacgcccagctaatttttgtgtttttagtggagatggggttttaccatgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttggagatcagcctgggcaacatggccagacctcctctctacaaaaagaaaaaagaatgacatgcttcttgtttttgtctgttataaatgaaactgctatatttgaatgcagttgttcatgtaggtatgtttcactatggtaatatggtggtgtgcagtgcctgagtcacgtgatagattaaagtacaactcttttttgagacagagtctcactctgtcacccaggcgggagttaggtggcatgatttcggctcactgcaacctctgcctcccaagttcaactgattcttctgcctcagcctcccgagtagcagggattaccggtgtgcaccaccatgcctggataacttttttttttatttctattagcaatggggtttcaccatgctggccaggcttgttatgaactgacctcaagtgatctgcctgcctcagcttctcaggtgtgacctactgtgcttggcctaatgtacaactttttaagcaatgccaaactatgacttaagaatgaaattattgctcatttgtatatctatctaccatcagtgtccaagaatttctgttctatcttaccaagagggagtatggttagtatttgaaattgtttattattttaataagtggttataacttttgagtcagtggtttatgttttgcattttttttgttttgagacaaagtctcgctctgtctcccaggctagagtaccgtggcacaatctcagctcattgcaacctctgcttcctgggctcaagcactctgcccacctcagcctccagagtagctggaaatacaggtatgcaccaccacaactggataacttttgtattttctgtagagagggttttacctttttgcccagtctgatcgcgaactcctgggctcaggcgatccacttgcctaggctccaaaagtgcttggtctacaggggtgaggcaccctgcctggcctcacctgtaggcttgttttttaaaatgaattttatctatttcccatttcattaatatatttaaaaataatgaaataacaaagacgtatgttggacttcattcattcttcagtgatgtcactttgctgcaaggaatatttggttttcttttttttttttttttccagatggagtctagctctgtctcctaagctacagtgaagtggcatgatctcggcccactgcaacctccacctcctgtgttcaagcgattctgcctcagcctcctgagtagctgggactacnggcatgtgccattatacctggctaattttatttatttattttagtagagatggggtttcaccatgttacccaggctgctctctaccttctgagctcaagtgatccacctgcctcggcctcccaaagtgctgggattacaggtgtcagccactgtacctggctgaatacttggttttcagtaccacaagaactatgagctggttatccacttcatgtggaatcataagcgtcccaaagtgacaatacatatagattgccaggcagtgaaacagttaagatgccaccatagctttcttttcaacatctttctaagattaccttactatttcttttgttccaagtttgtacttcctcacagttctcacatatggaaaggatacacactttgtagaaacaagaactttatgttatccaagttctaggatagccatgagctccaattatctcagagctctgagtcctctactcaatacccattgagatttatgtgttctgaggcttttgtcttctagctacttacttcattctccatgggtaacgtcattcatccacattaactaatttcctcactccaagctcttttctagagataatctccagtccctgtgcagaaactgtcattgcactttctgctgaaatggcagtttcttctcagcaaggtgagattatggaatccagaatcttttttcaggggtcacatgcccatttccccacttgcatgaatgtcgacactgcagccacagttttggccgtaaatgtgaatttggcaagtaaccactgttcccagggaaatgtcccaatcagaagaagattatctgggacactgatactgacagggagatgggacattctgagggacccggaggcagggtgccacctcctcaacttccctgagggctgcctagaatctgtttcctctcactctgaattattcttcctcttatggctgaccaaaaacatggaacctcacaaagtccactgtaacagctttatatttgtgaagtgaagaacatgaagacagtttcaagcaaagttattgagtggacactttgtgttttttttgagaagtctcactctttcacccaggctggagtgcagtggcacgatctcggctcactgcaactccacctcccgggttcacgccattctcttgcctcagcctcctgagtagctgggaccacaagcgcccaccacgtcagcttaatttttttgttttgtttcttgagacagagtcttgctctcttgcccaggttggagtgccgtgtcgcaatctcagctcactgcaacttctacctcctggattcaagcacttctccttgcctcagccacctctttagctgggattacaggtgcgtgccaccacacccagctaattaccttgtattacagcatgttatataagcacatacaggcacatacatgaaatagtgatacttcattctcagtaatatcttcatccttctcactggaaagatctttgatgatttttaatcaacataggagtttcaatgatatctagaagtttaaaagggctcgttcaaacaaattatgaccacacacactgaagagtatgtttgtctcttgtggtgtaaatttttttttattacaccaaattatgttcacacaaaacctttgtaatcagggggaattaaagagccttcctggaaaatggaggttgcaatcagccgagatggtgccatcgcactctagcctggggaatagagtgagatcctgcctcaaaaaaaacaaaaaaattctttattttctccataaactacagtttatataagcaaaagtttcagtactaagcaattttagtctctgcagtctcttgtcttgaattaatacaacttttgttaattctcttatgaagttaatcttcctgcttgtatgtgaattaaatatatgtcaaactttttttgtacaaaagattcatacctctttcctgtttgaaattattttactgtgtttcatcaatctaatgtttatttttattacaccagtaatttcctcattgtgttgaatcttacagtggcttataaatctacatgtacctagaaatgtttagccagtccatgtatatttgatgtggcacattttttcctttgaatcacatactctaagagaagtaacttcctcttgctaacctctactttccctaagtgttgaattaatcctctttagatgattataattctcttttcaatagctagaaagaatctataaggaactttcctggctgggtgtggtggctcatgcctgtaatcccagcacttcaggaggccgaggtgggtggatcacgaggtcaggagttccagaccagcctgaccaacatggttaaaccatgtctttactaaaaatgcaaaaattagcacctgtaatcccagctactcaggaggctgaggcatagaattgcttgaacctggcaggcagaggtggtgagccgagatcacggcactgcactccagcctgggtgacaagagcaagactccgtctcaaaataaataaataaaaataaaaaataaacatgatgatcacagatgcagtcacattttctgagttcttgtctctctgccagtgccacccagatagcctcacaaaactttgacccagccactgttagtgtcgccaccgcccataaaggagctgagcccagcaggggcactgcctggggccctgtagccaaaaggctacagcaggagctgatgaccctcatgatgcctggtgacaaaagaatttctgcctaccctgaaagccttatcaaatggacaccatccatgaagcagctggcacagtgtatgaagatctgaggtataagctcttgctggagttcctcaatgactacccacctttacgatgcacccacagtgaagttcctcacaccctgctaccaccctaacgtggacacccagggtaacatatgcctggacatcctgaaggagaagtggtctgccccgtatgatatcaggaccatcctgctctctatccagtgcctgctaggacaactcaacattgatagccctttgaacacacatgctaccaagctctgggaaaaccccatagctttaagaagtacctgcaagggtcaggcgcagtggctcacacctgtaatcccagcactttgggaggccgaggtgggtggatggatcacctgacgtagagagtccaaggcctgacaaacatggagaaatgtcatccctatttaaaaaaataaaaaaattagccaagtgtggtggcgcatgcctgtaatcccagctactcgggaggctgaggcaggagaatcacttgaacctgggaggtggaggttgcagtgagccgagatctcgctattgcactccagcctgggcaacaagagtgaaactctgcctcaaaaaaaaataaaataaaataaaaataaaaataaggaagtacctgcaagaaagctactcaaagtaggtcaccagccaggagctctgacccaggctgcccagcctatccttgtgttgtctttttaattttcccttagatggtctgccctttccgtgatttctgtgtagaactctgtatcttgagctgtggtactatttttcttttgtcttttaatttaaatcttgttgggagctcttgtgatgaatattaaatacatacattttgggctgggtgtggtgcctctagcctataatcccagcactttgggaggccgaggcaggcgaatcgtgaggtcaggagatcgagaccatcctgcctaacacggtgaaacctcgtctctactaaaaatacaaaaaaattagccgggcgtggtggcgggtgcctatagtcccagctgctcgggaggctgaggcaggagaatggcatgaacccgggaggtggagcttgcagtgagctgagattgcaccactgcactccaggctgggcacagagcaagactccatctcaaaaaaaaaaaaaaaaaaaagacaaaaagaaaacattttggtcattaaaaaacaaaaaaaaaatgatacgagagagcacccagggattataagaggaaacactttattacatcactcatctaacattccagaaaatggaaagtactctactgtacagcaaagtaaatcattggttgtctggagaacagaaagaaagcctttataaaaaggttccaagtaaatataaaggtgttaagttcattattgtgactatgttaatggtttcatgggattatatgaaactcaagatttatcacatgctacagcttaaatatgcatagcttactgaatgtcatttataactcatcacagctttaaaatatacttcagactggcagcagtggctcacacctgtattcccaccactctgggaggctgaggcaggcatatcacctgaggtcaggagtccaagatcagcctggccaacatggcaaaactccgtctctactaaaaatacaaaacttggccgggcatggtggcacatgcttccagtcccacctacatgggaggctgagcc

SEQ ID NO: 369491 - DNA, 8075 bp, Homo sapiens
  misc_feature (3605)..(3605): n is a, c, g, or t
cggggtcctcttgtagcggccacgttgatctgcgatacgcgtgtttgcccagtgagtggccccggactgctacgtgggactgcggtgaatgaacccagaaggtggagaggaaccgttctcggtgcacagaggcggctctgcagcccggtgagggcgcctgctgctcccgggcagtgctttccccaagtagtccgatggctgcggctgcgccgaggcgccctactcaggagcaacttggcgaggttcagactcttggagccagaagctacatgacccctaaacgggcacagtgacttttgaagacgtggctgtgaaatttacccaggaggaatggaatctccttagtgaggctcagagatgcctgtaccgtgatgtgactctggagaacctggcacttatgtcctccctggcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtacacaccaccacgcccagctaatttttgtgtttttagtggagatggggttttaccatgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttggagatcagcctgggcaacatggccagacctcctctctacaaaaagaaaaaagaatgacatgcttcttgtttttgtctgttataaatgaaactgctatatttgaatgcagttgttcatgtaggtatgtttcactatggtaatatggtggtgtgcagtgcctgagtcacgtgatagattaaagtacaactcttttttgagacagagtctcactctgtcacccaggcgggagttaggtggcatgatttcggctcactgcaacctctgcctcccaagttcaactgattcttctgcctcagcctcccgagtagcagggattaccggtgtgcaccaccatgcctggataacttttttttttatttctattagcaatggggtttcaccatgctggccaggcttgttatgaactgacctcaagtgatctgcctgcctcagcttctcaggtgtgacctactgtgcttggcctaatgtacaactttttaagcaatgccaaactatgacttaagaatgaaattattgctcatttgtatatctatctaccatcagtgtccaagaatttctgttctatcttaccaagagggagtatggttagtatttgaaattgtttattattttaataagtggttataacttttgagtcagtggtttatgttttgcattttttttgttttgagacaaagtctcgctctgtctcccaggctagagtaccgtggcacaatctcagctcattgcaacctctgcttcctgggctcaagcactctgcccacctcagcctccagagtagctggaaatacaggtatgcaccaccacaactggataacttttgtattttctgtagagagggttttacctttttgcccagtctgatcgcgaactcctgggctcaggcgatccacttgcctaggctccaaaagtgcttggtctacaggggtgaggcaccctgcctggcctcacctgtaggcttgttttttaaaatgaattttatctatttcccatttcattaatatatttaaaaataatgaaataacaaagacgtatgttggacttcattcattcttcagtgatgtcactttgctgcaaggaatatttggttttcttttttttttttttttccagatggagtctagctctgtctcctaagctacagtgaagtggcatgatctcggcccactgcaacctccacctcctgtgttcaagcgattctgcctcagcctcctgagtagctgggactacnggcatgtgccattatacctggctaattttatttatttattttagtagagatggggtttcaccatgttacccaggctgctctctaccttctgagctcaagtgatccacctgcctcggcctcccaaagtgctgggattacaggtgtcagccactgtacctggctgaatacttggttttcagtaccacaagaactatgagctggttatccacttcatgtggaatcataagcgtcccaaagtgacaatacatatagattgccaggcagtgaaacagttaagatgccaccatagctttcttttcaacatctttctaagattaccttactatttcttttgttccaagtttgtacttcctcacagttctcacatatggaaaggatacacactttgtagaaacaagaactttatgttatccaagttctaggatagccatgagctccaattatctcagagctctgagtcctctactcaatacccattgagatttatgtgttctgaggcttttgtcttctagctacttacttcattctccatgggtaacgtcattcatccacattaactaatttcctcactccaagctcttttctagagataatctccagtccctgtgcagaaactgtcattgcactttctgctgaaatggcagtttcttctcagcaaggtgagattatggaatccagaatcttttttcaggggtcacatgcccatttccccacttgcatgaatgtcgacactgcagccacagttttggccgtaaatgtgaatttggcaagtaaccactgttcccagggaaatgtcccaatcagaagaagattatctgggacactgatactgacagggagatgggacattctgagggacccggaggcagggtgccacctcctcaacttccctgagggctgcctagaatctgtttcctctcactctgaattattcttcctcttatggctgaccaaaaacatggaacctcacaaagtccactgtaacagctttatatttgtgaagtgaagaacatgaagacagtttcaagcaaagttattgagtggacactttgtgttttttttgagaagtctcactctttcacccaggctggagtgcagtggcacgatctcggctcactgcaactccacctcccgggttcacgccattctcttgcctcagcctcctgagtagctgggaccacaagcgcccaccacgtcagcttaatttttttgttttgtttcttgagacagagtcttgctctcttgcccaggttggagtgccgtgtcgcaatctcagctcactgcaacttctacctcctggattcaagcacttctccttgcctcagccacctctttagctgggattacaggtgcgtgccaccacacccagctaattaccttgtattacagcatgttatataagcacatacaggcacatacatgaaatagtgatacttcattctcagtaatatcttcatccttctcactggaaagatctttgatgatttttaatcaacataggagtttcaatgatatctagaagtttaaaagggctcgttcaaacaaattatgaccacacacactgaagagtatgtttgtctcttgtggtgtaaatttttttttattacaccaaattatgttcacacaaaacctttgtaatcagggggaattaaagagccttcctggaaaatggaggttgcaatcagccgagatggtgccatcgcactctagcctggggaatagagtgagatcctgcctcaaaaaaaacaaaaaaattctttattttctccataaactacagtttatataagcaaaagtttcagtactaagcaattttagtctctgcagtctcttgtcttgaattaatacaacttttgttaattctcttatgaagttaatcttcctgcttgtatgtgaattaaatatatgtcaaactttttttgtacaaaagattcatacctctttcctgtttgaaattattttactgtgtttcatcaatctaatgtttatttttattacaccagtaatttcctcattgtgttgaatcttacagtggcttataaatctacatgtacctagaaatgtttagccagtccatgtatatttgatgtggcacattttttcctttgaatcacatactctaagagaagtaacttcctcttgctaacctctactttccctaagtgttgaattaatcctctttagatgattataattctcttttcaatagctagaaagaatctataaggaactttcctggctgggtgtggtggctcatgcctgtaatcccagcacttcaggaggccgaggtgggtggatcacgaggtcaggagttccagaccagcctgaccaacatggttaaaccatgtctttactaaaaatgcaaaaattagcacctgtaatcccagctactcaggaggctgaggcatagaattgcttgaacctggcaggcagaggtggtgagccgagatcacggcactgcactccagcctgggtgacaagagcaagactccgtctcaaaataaataaataaaaataaaaaataaacatgatgatcacagatgcagtcacattttctgagttcttgtctctctgccagtgccacccagatagcctcacaaaactttgacccagccactgttagtgtcgccaccgcccataaaggagctgagcccagcaggggcactgcctggggccctgtagccaaaaggctacagcaggagctgatgaccctcatgatgcctggtgacaaaagaatttctgcctaccctgaaagccttatcaaatggacaccatccatgaagcagctggcacagtgtatgaagatctgaggtataagctcttgctggagttcctcaatgactacccacctttacgatgcacccacagtgaagttcctcacaccctgctaccaccctaacgtggacacccagggtaacatatgcctggacatcctgaaggagaagtggtctgccccgtatgatatcaggaccatcctgctctctatccagtgcctgctaggacaactcaacattgatagccctttgaacacacatgctaccaagctctgggaaaaccccatagctttaagaagtacctgcaagggtcaggcgcagtggctcacacctgtaatcccagcactttgggaggccgaggtgggtggatggatcacctgacgtagagagtccaaggcctgacaaacatggagaaatgtcatccctatttaaaaaaataaaaaaattagccaagtgtggtggcgcatgcctgtaatcccagctactcgggaggctgaggcaggagaatcacttgaacctgggaggtggaggttgcagtgagccgagatctcgctattgcactccagcctgggcaacaagagtgaaactctgcctcaaaaaaaaataaaataaaataaaaataaaaataaggaagtacctgcaagaaagctactcaaagtaggtcaccagccaggagctctgacccaggctgcccagcctatccttgtgttgtctttttaattttcccttagatggtctgccctttccgtgatttctgtgtagaactctgtatcttgagctgtggtactatttttcttttgtcttttaatttaaatcttgttgggagctcttgtgatgaatattaaatacatacattttgggctgggtgtggtgcctctagcctataatcccagcactttgggaggccgaggcaggcgaatcgtgaggtcaggagatcgagaccatcctgcctaacacggtgaaacctcgtctctactaaaaatacaaaaaaattagccgggcgtggtggcgggtgcctatagtcccagctgctcgggaggctgaggcaggagaatggcatgaacccgggaggtggagcttgcagtgagctgagattgcaccactgcactccaggctgggcacagagcaagactccatctcaaaaaaaaaaaaaaaaaaaagacaaaaagaaaacattttggtcattaaaaaacaaaaaaaaaatgatacgagagagcacccagggattataagaggaaacactttattacatcactcatctaacattccagaaaatggaaagtactctactgtacagcaaagtaaatcattggttgtctggagaacagaaagaaagcctttataaaaaggttccaagtaaatataaaggtgttaagttcattattgtgactatgttaatggtttcatgggattatatgaaactcaagatttatcacatgctacagcttaaatatgcatagcttactgaatgtcatttataactcatcacagctttaaaatatacttcagactggcagcagtggctcacacctgtattcccaccactctgggaggctgaggcaggcatatcacctgaggtcaggagtccaagatcagcctggccaacatggcaaaactccgtctctactaaaaatacaaaacttggccgggcatggtggcacatgcttccagtcccacctacatgggaggctgagcc

SEQ ID NO: 369492 - DNA, 4884 bp, Homo sapiens
ggccgagacttccggggtctctagtagcggctgtgtatcggcgatgcgggtgtttccccagtttgtggcccctgagtgctgggtgggaccgcggtgactgaacctagaaggtggagaggaatcgtcctcggtgcccagaggcggctctgcagccccgtgacggcgaccactgctcccgggccgtgcttccccaagtagtccgatggcagcggctgtgccgaggcgcccaactcagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtacacaccaccacgcccagctaatttttgtgtttttagtggagatggggttttaccatgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttggagatcagcctgggcaacatggccagacctcctctctacaaaaagaaaaaagaatgacatgcttcttgtttttgtctgttataaatgaaactgctatatttgaatgcagttgttcatgtaggtatgtttcactatggtaatatggtggtgtgcagtgcctgagtcacgtgatagattaaagtacaactcttttttgagacagagtctcactctgtcacccaggcgggagttaggtggcatgatttcggctcactgcaacctctgcctcccaagttcaactgattcttctgcctcagcctcccgagtagcagggattaccggtgtgcaccaccatgcctggataacttttttttttatttctattagcaatggggtttcaccatgctggccaggcttgttatgaactgacctcaagtgatctgcctgcctcagcttctcaggtgtgacctactgtgcttggcctaatgtacaactttttaagcaatgccaaactatgacttaagaatgaaattattgctcatttgtatatctatctaccatcagtgtccaagaatttctgttctatcttaccaagagggagtatggttagtatttgaaattgtttattattttaataagtggttataacttttgagtcagtggtttatgttttgcattttttttgttttgagacaaagtctcgctctgtctcccaggctagagtaccgtggcacaatctcagctcattgcaacctctgcttcctgggctcaagcactctgcccacctcagcctccagagtagctggaaatacagtgccacccagatagcctcacaaaactttgacccagccactgttagtgtcgccaccgcccataaaggagctgagcccagcaggggcactgcctggggccctgtagccaaaaggctacagcaggagctgatgaccctcatgatgcctggtgacaaaagaatttctgcctaccctgaaagccttatcaaatggacaccatccatgaagcagctggcacagtgtatgaagatctgaggtataagctcttgctggagttcctcaatgactacccacctttacgatgcacccacagtgaagttcctcacaccctgctaccaccctaacgtggacacccagggtaacatatgcctggacatcctgaaggagaagtggtctgccccgtatgatatcaggaccatcctgctctctatccagtgcctgctaggacaactcaacattgatagccctttgaacacacatgctaccaagctctgggaaaaccccatagctttaagaagtacctgcaagggtcaggcgcagtggctcacacctgtaatcccagcactttgggaggccgaggtgggtggatggatcacctgacgtagagagtccaaggcctgacaaacatggagaaatgtcatccctatttaaaaaaataaaaaaattagccaagtgtggtggcgcatgcctgtaatcccagctactcgggaggctgaggcaggagaatcacttgaacctgggaggtggaggttgcagtgagccgagatctcgctattgcactccagcctgggcaacaagagtgaaactctgcctcaaaaaaaaataaaataaaataaaaataaaaataaggaagtacctgcaagaaagctactcaaagtaggtcaccagccaggagctctgacccaggctgcccagcctatccttgtgttgtctttttaattttcccttagatggtctgccctttccgtgatttctgtgtagaactctgtatcttgagctgtggtactatttttcttttgtcttttaatttaaatcttgttgggagctcttgtgatgaatattaaatacatacattttgggctgggtgtggtgcctctagcctataatcccagcactttgggaggccgaggcaggcgaatcgtgaggtcaggagatcgagaccatcctgcctaacacggtgaaacctcgtctctactaaaaatacaaaaaaattagccgggcgtggtggcgggtgcctatagtcccagctgctcgggaggctgaggcaggagaatggcatgaacccgggaggtggagcttgcagtgagctgagattgcaccactgcactccaggctgggcacagagcaagactccatctcaaaaaaaaaaaaaaaaaaaagacaaaaagaaaacattttggtcattaaaaaacaaaaaaaaaatgatacgagagagcacccagggattataagaggaaacactttattacatcactcatctaacattccagaaaatggaaagtactctactgtacagcaaagtaaatcattggttgtctggagaacagaaagaaagcctttataaaaaggttccaagtaaatataaaggtgttaagttcattattgtgactatgttaatggtttcatgggattatatgaaactcaagatttatcacatgctacagcttaaatatgcatagcttactgaatgtcatttataactcatcacagctttaaaatatacttcagactggcagcagtggctcacacctgtattcccaccactctgggaggctgaggcaggcatatcacctgaggtcaggagtccaagatcagcctggccaacatggcaaaactccgtctctactaaaaatacaaaacttggccgggcatggtggcacatgcttccagtcccacctacatgggaggctgagcc

SEQ ID NO: 369493 - DNA, 7738 bp, Homo sapiens
  misc_feature (3268)..(3268): n is a, c, g, or t
cgcctcagcctcccaaagtgctgggattacaggtgtgagccaccatgcccagccagcagccccatcttcaacttgaagccaacattgtgttcctgcaaatatttctatagattaattcctcaatttgtgagacgtacttgtgggtgggctgtgccttcccgccggaggtactttgcacttgaccagcattttcttgctttcaggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtacacaccaccacgcccagctaatttttgtgtttttagtggagatggggttttaccatgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttggagatcagcctgggcaacatggccagacctcctctctacaaaaagaaaaaagaatgacatgcttcttgtttttgtctgttataaatgaaactgctatatttgaatgcagttgttcatgtaggtatgtttcactatggtaatatggtggtgtgcagtgcctgagtcacgtgatagattaaagtacaactcttttttgagacagagtctcactctgtcacccaggcgggagttaggtggcatgatttcggctcactgcaacctctgcctcccaagttcaactgattcttctgcctcagcctcccgagtagcagggattaccggtgtgcaccaccatgcctggataacttttttttttatttctattagcaatggggtttcaccatgctggccaggcttgttatgaactgacctcaagtgatctgcctgcctcagcttctcaggtgtgacctactgtgcttggcctaatgtacaactttttaagcaatgccaaactatgacttaagaatgaaattattgctcatttgtatatctatctaccatcagtgtccaagaatttctgttctatcttaccaagagggagtatggttagtatttgaaattgtttattattttaataagtggttataacttttgagtcagtggtttatgttttgcattttttttgttttgagacaaagtctcgctctgtctcccaggctagagtaccgtggcacaatctcagctcattgcaacctctgcttcctgggctcaagcactctgcccacctcagcctccagagtagctggaaatacaggtatgcaccaccacaactggataacttttgtattttctgtagagagggttttacctttttgcccagtctgatcgcgaactcctgggctcaggcgatccacttgcctaggctccaaaagtgcttggtctacaggggtgaggcaccctgcctggcctcacctgtaggcttgttttttaaaatgaattttatctatttcccatttcattaatatatttaaaaataatgaaataacaaagacgtatgttggacttcattcattcttcagtgatgtcactttgctgcaaggaatatttggttttcttttttttttttttttccagatggagtctagctctgtctcctaagctacagtgaagtggcatgatctcggcccactgcaacctccacctcctgtgttcaagcgattctgcctcagcctcctgagtagctgggactacnggcatgtgccattatacctggctaattttatttatttattttagtagagatggggtttcaccatgttacccaggctgctctctaccttctgagctcaagtgatccacctgcctcggcctcccaaagtgctgggattacaggtgtcagccactgtacctggctgaatacttggttttcagtaccacaagaactatgagctggttatccacttcatgtggaatcataagcgtcccaaagtgacaatacatatagattgccaggcagtgaaacagttaagatgccaccatagctttcttttcaacatctttctaagattaccttactatttcttttgttccaagtttgtacttcctcacagttctcacatatggaaaggatacacactttgtagaaacaagaactttatgttatccaagttctaggatagccatgagctccaattatctcagagctctgagtcctctactcaatacccattgagatttatgtgttctgaggcttttgtcttctagctacttacttcattctccatgggtaacgtcattcatccacattaactaatttcctcactccaagctcttttctagagataatctccagtccctgtgcagaaactgtcattgcactttctgctgaaatggcagtttcttctcagcaaggtgagattatggaatccagaatcttttttcaggggtcacatgcccatttccccacttgcatgaatgtcgacactgcagccacagttttggccgtaaatgtgaatttggcaagtaaccactgttcccagggaaatgtcccaatcagaagaagattatctgggacactgatactgacagggagatgggacattctgagggacccggaggcagggtgccacctcctcaacttccctgagggctgcctagaatctgtttcctctcactctgaattattcttcctcttatggctgaccaaaaacatggaacctcacaaagtccactgtaacagctttatatttgtgaagtgaagaacatgaagacagtttcaagcaaagttattgagtggacactttgtgttttttttgagaagtctcactctttcacccaggctggagtgcagtggcacgatctcggctcactgcaactccacctcccgggttcacgccattctcttgcctcagcctcctgagtagctgggaccacaagcgcccaccacgtcagcttaatttttttgttttgtttcttgagacagagtcttgctctcttgcccaggttggagtgccgtgtcgcaatctcagctcactgcaacttctacctcctggattcaagcacttctccttgcctcagccacctctttagctgggattacaggtgcgtgccaccacacccagctaattaccttgtattacagcatgttatataagcacatacaggcacatacatgaaatagtgatacttcattctcagtaatatcttcatccttctcactggaaagatctttgatgatttttaatcaacataggagtttcaatgatatctagaagtttaaaagggctcgttcaaacaaattatgaccacacacactgaagagtatgtttgtctcttgtggtgtaaatttttttttattacaccaaattatgttcacacaaaacctttgtaatcagggggaattaaagagccttcctggaaaatggaggttgcaatcagccgagatggtgccatcgcactctagcctggggaatagagtgagatcctgcctcaaaaaaaacaaaaaaattctttattttctccataaactacagtttatataagcaaaagtttcagtactaagcaattttagtctctgcagtctcttgtcttgaattaatacaacttttgttaattctcttatgaagttaatcttcctgcttgtatgtgaattaaatatatgtcaaactttttttgtacaaaagattcatacctctttcctgtttgaaattattttactgtgtttcatcaatctaatgtttatttttattacaccagtaatttcctcattgtgttgaatcttacagtggcttataaatctacatgtacctagaaatgtttagccagtccatgtatatttgatgtggcacattttttcctttgaatcacatactctaagagaagtaacttcctcttgctaacctctactttccctaagtgttgaattaatcctctttagatgattataattctcttttcaatagctagaaagaatctataaggaactttcctggctgggtgtggtggctcatgcctgtaatcccagcacttcaggaggccgaggtgggtggatcacgaggtcaggagttccagaccagcctgaccaacatggttaaaccatgtctttactaaaaatgcaaaaattagcacctgtaatcccagctactcaggaggctgaggcatagaattgcttgaacctggcaggcagaggtggtgagccgagatcacggcactgcactccagcctgggtgacaagagcaagactccgtctcaaaataaataaataaaaataaaaaataaacatgatgatcacagatgcagtcacattttctgagttcttgtctctctgccagtgccacccagatagcctcacaaaactttgacccagccactgttagtgtcgccaccgcccataaaggagctgagcccagcaggggcactgcctggggccctgtagccaaaaggctacagcaggagctgatgaccctcatgatgcctggtgacaaaagaatttctgcctaccctgaaagccttatcaaatggacaccatccatgaagcagctggcacagtgtatgaagatctgaggtataagctcttgctggagttcctcaatgactacccacctttacgatgcacccacagtgaagttcctcacaccctgctaccaccctaacgtggacacccagggtaacatatgcctggacatcctgaaggagaagtggtctgccccgtatgatatcaggaccatcctgctctctatccagtgcctgctaggacaactcaacattgatagccctttgaacacacatgctaccaagctctgggaaaaccccatagctttaagaagtacctgcaagggtcaggcgcagtggctcacacctgtaatcccagcactttgggaggccgaggtgggtggatggatcacctgacgtagagagtccaaggcctgacaaacatggagaaatgtcatccctatttaaaaaaataaaaaaattagccaagtgtggtggcgcatgcctgtaatcccagctactcgggaggctgaggcaggagaatcacttgaacctgggaggtggaggttgcagtgagccgagatctcgctattgcactccagcctgggcaacaagagtgaaactctgcctcaaaaaaaaataaaataaaataaaaataaaaataaggaagtacctgcaagaaagctactcaaagtaggtcaccagccaggagctctgacccaggctgcccagcctatccttgtgttgtctttttaattttcccttagatggtctgccctttccgtgatttctgtgtagaactctgtatcttgagctgtggtactatttttcttttgtcttttaatttaaatcttgttgggagctcttgtgatgaatattaaatacatacattttgggctgggtgtggtgcctctagcctataatcccagcactttgggaggccgaggcaggcgaatcgtgaggtcaggagatcgagaccatcctgcctaacacggtgaaacctcgtctctactaaaaatacaaaaaaattagccgggcgtggtggcgggtgcctatagtcccagctgctcgggaggctgaggcaggagaatggcatgaacccgggaggtggagcttgcagtgagctgagattgcaccactgcactccaggctgggcacagagcaagactccatctcaaaaaaaaaaaaaaaaaaaagacaaaaagaaaacattttggtcattaaaaaacaaaaaaaaaatgatacgagagagcacccagggattataagaggaaacactttattacatcactcatctaacattccagaaaatggaaagtactctactgtacagcaaagtaaatcattggttgtctggagaacagaaagaaagcctttataaaaaggttccaagtaaatataaaggtgttaagttcattattgtgactatgttaatggtttcatgggattatatgaaactcaagatttatcacatgctacagcttaaatatgcatagcttactgaatgtcatttataactcatcacagctttaaaatatacttcagactggcagcagtggctcacacctgtattcccaccactctgggaggctgaggcaggcatatcacctgaggtcaggagtccaagatcagcctggccaacatggcaaaactccgtctctactaaaaatacaaaacttggccgggcatggtggcacatgcttccagtcccacctacatgggaggctgagcc

SEQ ID NO: 369494 - DNA, 6120 bp, Homo sapiens
  misc_feature (975)..(975): n is a, c, g, or t
ggcacgaggattgaagtgtttagttctatcatgttttcagcctcccgagtagcagggattaccggtgtgcaccaccatgcctggataacttttttttttatttctattagcaatggggtttcaccatgctggccaggcttgttatgaactgacctcaagtgatctgcctgcctcagcttctcaggtgtgacctactgtgcttggcctaatgtacaactttttaagcaatgccaaactatgacttaagaatgaaattattgctcatttgtatatctatctaccatcagtgtccaagaatttctgttctatcttaccaagagggagtatggttagtatttgaaattgtttattattttaataagtggttataacttttgagtcagtggtttatgttttgcattttttttgttttgagacaaagtctcgctctgtctcccaggctagagtaccgtggcacaatctcagctcattgcaacctctgcttcctgggctcaagcactctgcccacctcagcctccagagtagctggaaatacaggtatgcaccaccacaactggataacttttgtattttctgtagagagggttttacctttttgcccagtctgatcgcgaactcctgggctcaggcgatccacttgcctaggctccaaaagtgcttggtctacaggggtgaggcaccctgcctggcctcacctgtaggcttgttttttaaaatgaattttatctatttcccatttcattaatatatttaaaaataatgaaataacaaagacgtatgttggacttcattcattcttcagtgatgtcactttgctgcaaggaatatttggttttcttttttttttttttttccagatggagtctagctctgtctcctaagctacagtgaagtggcatgatctcggcccactgcaacctccacctcctgtgttcaagcgattctgcctcagcctcctgagtagctgggactacnggcatgtgccattatacctggctaattttatttatttattttagtagagatggggtttcaccatgttacccaggctgctctctaccttctgagctcaagtgatccacctgcctcggcctcccaaagtgctgggattacaggtgtcagccactgtacctggctgaatacttggttttcagtaccacaagaactatgagctggttatccacttcatgtggaatcataagcgtcccaaagtgacaatacatatagattgccaggcagtgaaacagttaagatgccaccatagctttcttttcaacatctttctaagattaccttactatttcttttgttccaagtttgtacttcctcacagttctcacatatggaaaggatacacactttgtagaaacaagaactttatgttatccaagttctaggatagccatgagctccaattatctcagagctctgagtcctctactcaatacccattgagatttatgtgttctgaggcttttgtcttctagctacttacttcattctccatgggtaacgtcattcatccacattaactaatttcctcactccaagctcttttctagagataatctccagtccctgtgcagaaactgtcattgcactttctgctgaaatggcagtttcttctcagcaaggtgagattatggaatccagaatcttttttcaggggtcacatgcccatttccccacttgcatgaatgtcgacactgcagccacagttttggccgtaaatgtgaatttggcaagtaaccactgttcccagggaaatgtcccaatcagaagaagattatctgggacactgatactgacagggagatgggacattctgagggacccggaggcagggtgccacctcctcaacttccctgagggctgcctagaatctgtttcctctcactctgaattattcttcctcttatggctgaccaaaaacatggaacctcacaaagtccactgtaacagctttatatttgtgaagtgaagaacatgaagacagtttcaagcaaagttattgagtggacactttgtgttttttttgagaagtctcactctttcacccaggctggagtgcagtggcacgatctcggctcactgcaactccacctcccgggttcacgccattctcttgcctcagcctcctgagtagctgggaccacaagcgcccaccacgtcagcttaatttttttgttttgtttcttgagacagagtcttgctctcttgcccaggttggagtgccgtgtcgcaatctcagctcactgcaacttctacctcctggattcaagcacttctccttgcctcagccacctctttagctgggattacaggtgcgtgccaccacacccagctaatttttgtatttttagcagagaccaggtttcaccatgttggtcaggctggtctcaaactcctgacctcgtgatccacccacctcggcctcccaaagtgctggaattacaggcgtgagccactgcacctggcctgtattcttttctttagtagagacggggttttactgtatttgccaggatggtctcgatctccagacctcgtgatccgcccgccttagcctcccaaagtgctgggattataggcgtgagccaacacgccctggccacttcttgtctttgcaacattttttagatatgtatttgtgttttttggggagcttaatttgctaatggaatctctgttattttcctaacatgcttggtggatacaagagttaagacttcctgtcccgtttagtgtaacaaaagaaagttaagaaatgtggataaaagattgtaagttagaaatggcaagataatcagctatatgaagaatcttggccaggtgtggtggctgaggcctcctaaagtgctgggattacaggcatctgccaccgcactcggcttatccctagaaatcctatgatagcatgatgtataggcacctaaaggcatggcacttgagaaatgtgaataagattgtaagttacaaatagcaaggtacagtcagatgttaacagtctcagcccctaaatgtcaccttgtattacagcatgttatataagcacatacaggcacatacatgaaatagtgatacttcattctcagtaatatcttcatccttctcactggaaagatctttgatgatttttaatcaacataggagtttcaatgatatctagaagtttaaaagggctcgttcaaacaaattatgaccacacacactgaagagtatgtttgtctcttgtggtgtaaatttttttttattacaccaaattatgttcacacaaaacctttgtaatcagggggaattaaagagccttcctggaaaatggaggttgcaatcagccgagatggtgccatcgcactctagcctggggaatagagtgagatcctgcctcaaaaaaaacaaaaaaattctttattttctccataaactacagtttatataagcaaaagtttcagtactaagcaattttagtctctgcagtctcttgtcttgaattaatacaacttttgttaattctcttatgaagttaatcttcctgcttgtatgtgaattaaatatatgtcaaactttttttgtacaaaagattcatacctctttcctgtttgaaattattttactgtgtttcatcaatctaatgtttatttttattacaccagtaatttcctcattgtgttgaatcttacagtggcttataaatctacatgtacctagaaatgtttagccagtccatgtatatttgatgtggcacattttttcctttgaatcacatactctaagagaagtaacttcctcttgctaacctctactttccctaagtgttgaattaatcctctttagatgattataattctcttttcaatagctagaaagaatctataaggaactttcctggctgggtgtggtggctcatgcctgtaatcccagcacttcaggaggccgaggtgggtggatcacgaggtcaggagttccagaccagcctgaccaacatggttaaaccatgtctttactaaaaatgcaaaaattagcacctgtaatcccagctactcaggaggctgaggcatagaattgcttgaacctggcaggcagaggtggtgagccgagatcacggcactgcactccagcctgggtgacaagagcaagactccgtctcaaaataaataaataaaaataaaaaataaacatgatgatcacagatgcagtcacattttctgagttcttgtctctctgccagtgccacccagatagcctcacaaaactttgacccagccactgttagtgtcgccaccgcccataaaggagctgagcccagcaggggcactgcctggggccctgtagccaaaaggctacagcaggagctgatgaccctcatgatgcctggtgacaaaagaatttctgcctaccctgaaagccttatcaaatggacaccatccatgaagcagctggcacagtgtatgaagatctgaggtataagctcttgctggagttcctcaatgactacccacctttacgatgcacccacagtgaagttcctcacaccctgctaccaccctaacgtggacacccagggtaacatatgcctggacatcctgaaggagaagtggtctgccccgtatgatatcaggaccatcctgctctctatccagtgcctgctaggacaactcaacattgatagccctttgaacacacatgctaccaagctctgggaaaaccccatagctttaagaagtacctgcaagggtcaggcgcagtggctcacacctgtaatcccagcactttgggaggccgaggtgggtggatggatcacctgacgtagagagtccaaggcctgacaaacatggagaaatgtcatccctatttaaaaaaataaaaaaattagccaagtgtggtggcgcatgcctgtaatcccagctactcgggaggctgaggcaggagaatcacttgaacctgggaggtggaggttgcagtgagccgagatctcgctattgcactccagcctgggcaacaagagtgaaactctgcctcaaaaaaaaataaaataaaataaaaataaaaataaggaagtacctgcaagaaagctactcaaagtaggtcaccagccaggagctctgacccaggctgcccagcctatccttgtgttgtctttttaattttcccttagatggtctgccctttccgtgatttctgtgtagaactctgtatcttgagctgtggtactatttttcttttgtcttttaatttaaatcttgttgggagctcttgtgatgaatattaaatacatacattttgggctgggtgtggtgcctctagcctataatcccagcactttgggaggccgaggcaggcgaatcgtgaggtcaggagatcgagaccatcctgcctaacacggtgaaacctcgtctctactaaaaatacaaaaaaattagccgggcgtggtggcgggtgcctatagtcccagctgctcgggaggctgaggcaggagaatggcatgaacccgggaggtggagcttgcagtgagctgagattgcaccactgcactccaggctgggcacagagcaagactccatctcaaaaaaaaaaaaaaaaaaaagacaaaaagaaaacattttggtcattaaaaaacaaaaaaaaaatgatacgagagagcacccagggattataagaggaaacactttattacatcactcatctaacattccagaaaatggaaagtactctactgtacagcaaagtaaatcattggttgtctggagaacagaaagaaagcctttataaaaaggttccaagtaaatataaaggtgttaagttcattattgtgactatgttaatggtttcatgggattatatgaaactcaagatttatcacatgctacagcttaaatatgcatagcttactgaatgtcatttataactcatcacagctttaaaatatacttcagactggcagcagtggctcacacctgtattcccaccactctgggaggctgaggcaggcatatcacctgaggtcaggagtccaagatcagcctggccaacatggcaaaactccgtctctactaaaaatacaaaacttggccgggcatggtggcacatgcttccagtcccacctacatgggaggctgagcc

SEQ ID NO: 369495 - DNA, 8218 bp, Homo sapiens
  misc_feature (4024)..(4024): n is a, c, g, or t
acgtatggtgcagtacattgattgaagtaacatgagagagaaggggtgggtgtagcaaaaacattctcaaggccaagtcatcagcccttacccttaggagggggcagtgattaagaggtggtatgagagcctcgtttctcatttctataagtgctggtaaaggacctgaccccacttccttacctactgcctgcccaggtaactgatgcctacagcatcacaggaattgccaaaatgcagaaaacaaatcctaaattgctctaattccataacacaaaggctggtttttggcttgaaataatcaggcacatatatcatgttctgtcacccagggtggagtgcagtggtgtgatctcggctcactacaaaccccgcctcctgggttcacgccattctccggcctcagcctcccgagtagctgggactacaggtgcccaccaccatgcccggctaattttttgtatttttagtagagacagggtttcaccatgttaaccagcatagtctctatcccctgactgcaagatctgcccgaatcagtgtcccaaagtgctgggattacaggcgtgagccaccgcacccagcccagaagggagtggacctttttatgtcaggacctcagcatggatacctatttgtccacctacttcttgttgctgatggcatttgaccagcaggcccatgaagagacaaaggcaccagtggatgtggtttcaactccgtgttggggaccttgggaggaggatgggcaagggtgggcgtgtgggagaggtgggttgtggtacctcagcagaggggctgcttgtggcttcatctgtcactatcatagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtacacaccaccacgcccagctaatttttgtgtttttagtggagatggggttttaccatgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttggagatcagcctgggcaacatggccagacctcctctctacaaaaagaaaaaagaatgacatgcttcttgtttttgtctgttataaatgaaactgctatatttgaatgcagttgttcatgtaggtatgtttcactatggtaatatggtggtgtgcagtgcctgagtcacgtgatagattaaagtacaactcttttttgagacagagtctcactctgtcacccaggcgggagttaggtggcatgatttcggctcactgcaacctctgcctcccaagttcaactgattcttctgcctcagcctcccgagtagcagggattaccggtgtgcaccaccatgcctggataacttttttttttatttctattagcaatggggtttcaccatgctggccaggcttgttatgaactgacctcaagtgatctgcctgcctcagcttctcaggtgtgacctactgtgcttggcctaatgtacaactttttaagcaatgccaaactatgacttaagaatgaaattattgctcatttgtatatctatctaccatcagtgtccaagaatttctgttctatcttaccaagagggagtatggttagtatttgaaattgtttattattttaataagtggttataacttttgagtcagtggtttatgttttgcattttttttgttttgagacaaagtctcgctctgtctcccaggctagagtaccgtggcacaatctcagctcattgcaacctctgcttcctgggctcaagcactctgcccacctcagcctccagagtagctggaaatacaggtatgcaccaccacaactggataacttttgtattttctgtagagagggttttacctttttgcccagtctgatcgcgaactcctgggctcaggcgatccacttgcctaggctccaaaagtgcttggtctacaggggtgaggcaccctgcctggcctcacctgtaggcttgttttttaaaatgaattttatctatttcccatttcattaatatatttaaaaataatgaaataacaaagacgtatgttggacttcattcattcttcagtgatgtcactttgctgcaaggaatatttggttttcttttttttttttttttccagatggagtctagctctgtctcctaagctacagtgaagtggcatgatctcggcccactgcaacctccacctcctgtgttcaagcgattctgcctcagcctcctgagtagctgggactacnggcatgtgccattatacctggctaattttatttatttattttagtagagatggggtttcaccatgttacccaggctgctctctaccttctgagctcaagtgatccacctgcctcggcctcccaaagtgctgggattacaggtgtcagccactgtacctggctgaatacttggttttcagtaccacaagaactatgagctggttatccacttcatgtggaatcataagcgtcccaaagtgacaatacatatagattgccaggcagtgaaacagttaagatgccaccatagctttcttttcaacatctttctaagattaccttactatttcttttgttccaagtttgtacttcctcacagttctcacatatggaaaggatacacactttgtagaaacaagaactttatgttatccaagttctaggatagccatgagctccaattatctcagagctctgagtcctctactcaatacccattgagatttatgtgttctgaggcttttgtcttctagctacttacttcattctccatgggtaacgtcattcatccacattaactaatttcctcactccaagctcttttctagagataatctccagtccctgtgcagaaactgtcattgcactttctgctgaaatggcagtttcttctcagcaaggtgagattatggaatccagaatcttttttcaggggtcacatgcccatttccccacttgcatgaatgtcgacactgcagccacagttttggccgtaaatgtgaatttggcaagtaaccactgttcccagggaaatgtcccaatcagaagaagattatctgggacactgatactgacagggagatgggacattctgagggacccggaggcagggtgccacctcctcaacttccctgagggctgcctagaatctgtttcctctcactctgaattattcttcctcttatggctgaccaaaaacatggaacctcacaaagtccactgtaacagctttatatttgtgaagtgaagaacatgaagacagtttcaagcaaagttattgagtggacactttgtgttttttttgagaagtctcactctttcacccaggctggagtgcagtggcacgatctcggctcactgcaactccacctcccgggttcacgccattctcttgcctcagcctcctgagtagctgggaccacaagcgcccaccacgtcagcttaatttttttgttttgtttcttgagacagagtcttgctctcttgcccaggttggagtgccgtgtcgcaatctcagctcactgcaacttctacctcctggattcaagcacttctccttgcctcagccacctctttagctgggattacaggtgcgtgccaccacacccagctaattaccttgtattacagcatgttatataagcacatacaggcacatacatgaaatagtgatacttcattctcagtaatatcttcatccttctcactggaaagatctttgatgatttttaatcaacataggagtttcaatgatatctagaagtttaaaagggctcgttcaaacaaattatgaccacacacactgaagagtatgtttgtctcttgtggtgtaaatttttttttattacaccaaattatgttcacacaaaacctttgtaatcagggggaattaaagagccttcctggaaaatggaggttgcaatcagccgagatggtgccatcgcactctagcctggggaatagagtgagatcctgcctcaaaaaaaacaaaaaaattctttattttctccataaactacagtttatataagcaaaagtttcagtactaagcaattttagtctctgcagtctcttgtcttgaattaatacaacttttgttaattctcttatgaagttaatcttcctgcttgtatgtgaattaaatatatgtcaaactttttttgtacaaaagattcatacctctttcctgtttgaaattattttactgtgtttcatcaatctaatgtttatttttattacaccagtaatttcctcattgtgttgaatcttacagtggcttataaatctacatgtacctagaaatgtttagccagtccatgtatatttgatgtggcacattttttcctttgaatcacatactctaagagaagtaacttcctcttgctaacctctactttccctaagtgttgaattaatcctctttagatgattataattctcttttcaatagctagaaagaatctataaggaactttcctggctgggtgtggtggctcatgcctgtaatcccagcacttcaggaggccgaggtgggtggatcacgaggtcaggagttccagaccagcctgaccaacatggttaaaccatgtctttactaaaaatgcaaaaattagcacctgtaatcccagctactcaggaggctgaggcatagaattgcttgaacctggcaggcagaggtggtgagccgagatcacggcactgcactccagcctgggtgacaagagcaagactccgtctcaaaataaataaataaaaataaaaaataaacatgatgatcacagatgcagtcacattttctgagttcttgtctctctgccagtgccacccagatagcctcacaaaactttgacccagccactgttagtgtcgccaccgcccataaaggagctgagcccagcaggggcactgcctggggccctgtagccaaaaggctacagcaggagctgatgaccctcatgatgcctggtgacaaaagaatttctgcctaccctgaaagccttatcaaatggacaccatccatgaagcagctggcacagtgtatgaagatctgaggtataagctcttgctggagttcctcaatgactacccacctttacgatgcacccacagtgaagttcctcacaccctgctaccaccctaacgtggacacccagggtaacatatgcctggacatcctgaaggagaagtggtctgccccgtatgatatcaggaccatcctgctctctatccagtgcctgctaggacaactcaacattgatagccctttgaacacacatgctaccaagctctgggaaaaccccatagctttaagaagtacctgcaagggtcaggcgcagtggctcacacctgtaatcccagcactttgggaggccgaggccagcagatcacaaggtcaggagttcgagaccagcctggccaacatggtgaaaccccatctctactaaaaatacaaaaattagctgggtgtggtggcatgtgcctgtagtcccagctactcaggaggctgaggcaggagaatcgtttgaacctgggaggcagaggttgccgtgagccaagattatgccactgcactccagcctgggcaacagggtgaggctctgcctcaaaaaaaaagaaaaaaaaagaaaaaaaagacatgagttgcagttacattattctgtctcctccactgcctataaataaagtaattctataaaattataatttcacctgatagcattacaatctgtgatgttatcctacagaattctggatatcagggcatgtgtctgcattgcaagagctgggcaacagacttccctcagccgtaccaagtacaatgcaatatacctcgtaaaagaattttgtcttgttcaaaaaatgccagaaattgtcacaaaaaatgccctgtatccagctgacctatgaacccacaaattttagtatccgtgctacagataaagaccacaaagccctgaaggtcttctctggaggcctctggcagctatgcaaagcagtccacaagtggagaaagctacattctgcattcatactgttccatgagccacaaagtttagctatgccaacaaaagctgtgacccccttcatagtaacaggacctacttatttctgaaccacccatacagtgacaacaaccctcaagattgaagaaggctgaaacaataaggccttcataatagcacaaaccggagaaatgggaggcaagctgttcttaggatcatgacttggagggtagaaaatttgtcaagattgatgtgatacccacaagatctctgaaagacatagtccgtcttttcaagtcaacgtaagaggcctctgggataaaaatgggtaacgtccatggcatgacttatcagacagaaaaaaatgacaaaggaagaagtgctgaagctactcaacaaatccttctgtgactcgatcagaaattaaaagtta

SEQ ID NO: 369496 - DNA, 8410 bp, Homo sapiens
  misc_feature (3940)..(3940): n is a, c, g, or t
acgtatggtgcagtacattgattgaagtaacatgagagagaaggggtgggtgtagcaaaaacattctcaaggccaagtcatcagcccttacccttaggagggggcagtgattaagaggtggtatgagagcctcgtttctcatttctataagtgctggtaaaggacctgaccccacttccttacctactgcctgcccaggtaactgatgcctacagcatcacaggaattgccaaaatgcagaaaacaaatcctaaattgctctaattccataacacaaaggctggtttttggcttgaaataatcaggcacatatatcatgttctgtcacccagggtggagtgcagtggtgtgatctcggctcactacaaaccccgcctcctgggttcacgccattctccggcctcagcctcccgagtagctgggactacaggtgcccaccaccatgcccggctaattttttgtatttttagtagagacagggtttcaccatgttaaccagcatagtctctatcccctgactgcaagatctgcccgaatcagtgtcccaaagtgctgggattacaggcgtgagccaccgcacccagcccagaagggagtggacctttttatgtcaggacctcagcatggatacctatttgtccacctacttcttgttgctgatggcatttgaccagcaggcccatgaagagacaaaggcaccagtggatgtggtttcaactccgtgttggggaccttgggaggaggatgggcaagggtgggcgtgtgggagaggtgggttgtggtacctcagcagaggggctgcttgtggcttcatctgtcactatcatagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtacacaccaccacgcccagctaatttttgtgtttttagtggagatggggttttaccatgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttggagatcagcctgggcaacatggccagacctcctctctacaaaaagaaaaaagaatgacatgcttcttgtttttgtctgttataaatgaaactgctatatttgaatgcagttgttcatgtaggtatgtttcactatggtaatatggtggtgtgcagtgcctgagtcacgtgatagattaaagtacaactcttttttgagacagagtctcactctgtcacccaggcgggagttaggtggcatgatttcggctcactgcaacctctgcctcccaagttcaactgattcttctgcctcagcctcccgagtagcagggattaccggtgtgcaccaccatgcctggataacttttttttttatttctattagcaatggggtttcaccatgctggccaggcttgttatgaactgacctcaagtgatctgcctgcctcagcttctcaggtgtgacctactgtgcttggcctaatgtacaactttttaagcaatgccaaactatgacttaagaatgaaattattgctcatttgtatatctatctaccatcagtgtccaagaatttctgttctatcttaccaagagggagtatggttagtatttgaaattgtttattattttaataagtggttataacttttgagtcagtggtttatgttttgcattttttttgttttgagacaaagtctcgctctgtctcccaggctagagtaccgtggcacaatctcagctcattgcaacctctgcttcctgggctcaagcactctgcccacctcagcctccagagtagctggaaatacaggtatgcaccaccacaactggataacttttgtattttctgtagagagggttttacctttttgcccagtctgatcgcgaactcctgggctcaggcgatccacttgcctaggctccaaaagtgcttggtctacaggggtgaggcaccctgcctggcctcacctgtaggcttgttttttaaaatgaattttatctatttcccatttcattaatatatttaaaaataatgaaataacaaagacgtatgttggacttcattcattcttcagtgatgtcactttgctgcaaggaatatttggttttcttttttttttttttttccagatggagtctagctctgtctcctaagctacagtgaagtggcatgatctcggcccactgcaacctccacctcctgtgttcaagcgattctgcctcagcctcctgagtagctgggactacnggcatgtgccattatacctggctaattttatttatttattttagtagagatggggtttcaccatgttacccaggctgctctctaccttctgagctcaagtgatccacctgcctcggcctcccaaagtgctgggattacaggtgtcagccactgtacctggctgaatacttggttttcagtaccacaagaactatgagctggttatccacttcatgtggaatcataagcgtcccaaagtgacaatacatatagattgccaggcagtgaaacagttaagatgccaccatagctttcttttcaacatctttctaagattaccttactatttcttttgttccaagtttgtacttcctcacagttctcacatatggaaaggatacacactttgtagaaacaagaactttatgttatccaagttctaggatagccatgagctccaattatctcagagctctgagtcctctactcaatacccattgagatttatgtgttctgaggcttttgtcttctagctacttacttcattctccatgggtaacgtcattcatccacattaactaatttcctcactccaagctcttttctagagataatctccagtccctgtgcagaaactgtcattgcactttctgctgaaatggcagtttcttctcagcaaggtgagattatggaatccagaatcttttttcaggggtcacatgcccatttccccacttgcatgaatgtcgacactgcagccacagttttggccgtaaatgtgaatttggcaagtaaccactgttcccagggaaatgtcccaatcagaagaagattatctgggacactgatactgacagggagatgggacattctgagggacccggaggcagggtgccacctcctcaacttccctgagggctgcctagaatctgtttcctctcactctgaattattcttcctcttatggctgaccaaaaacatggaacctcacaaagtccactgtaacagctttatatttgtgaagtgaagaacatgaagacagtttcaagcaaagttattgagtggacactttgtgttttttttgagaagtctcactctttcacccaggctggagtgcagtggcacgatctcggctcactgcaactccacctcccgggttcacgccattctcttgcctcagcctcctgagtagctgggaccacaagcgcccaccacgtcagcttaatttttttgttttgtttcttgagacagagtcttgctctcttgcccaggttggagtgccgtgtcgcaatctcagctcactgcaacttctacctcctggattcaagcacttctccttgcctcagccacctctttagctgggattacaggtgcgtgccaccacacccagctaattaccttgtattacagcatgttatataagcacatacaggcacatacatgaaatagtgatacttcattctcagtaatatcttcatccttctcactggaaagatctttgatgatttttaatcaacataggagtttcaatgatatctagaagtttaaaagggctcgttcaaacaaattatgaccacacacactgaagagtatgtttgtctcttgtggtgtaaatttttttttattacaccaaattatgttcacacaaaacctttgtaatcagggggaattaaagagccttcctggaaaatggaggttgcaatcagccgagatggtgccatcgcactctagcctggggaatagagtgagatcctgcctcaaaaaaaacaaaaaaattctttattttctccataaactacagtttatataagcaaaagtttcagtactaagcaattttagtctctgcagtctcttgtcttgaattaatacaacttttgttaattctcttatgaagttaatcttcctgcttgtatgtgaattaaatatatgtcaaactttttttgtacaaaagattcatacctctttcctgtttgaaattattttactgtgtttcatcaatctaatgtttatttttattacaccagtaatttcctcattgtgttgaatcttacagtggcttataaatctacatgtacctagaaatgtttagccagtccatgtatatttgatgtggcacattttttcctttgaatcacatactctaagagaagtaacttcctcttgctaacctctactttccctaagtgttgaattaatcctctttagatgattataattctcttttcaatagctagaaagaatctataaggaactttcctggctgggtgtggtggctcatgcctgtaatcccagcacttcaggaggccgaggtgggtggatcacgaggtcaggagttccagaccagcctgaccaacatggttaaaccatgtctttactaaaaatgcaaaaattagcacctgtaatcccagctactcaggaggctgaggcatagaattgcttgaacctggcaggcagaggtggtgagccgagatcacggcactgcactccagcctgggtgacaagagcaagactccgtctcaaaataaataaataaaaataaaaaataaacatgatgatcacagatgcagtcacattttctgagttcttgtctctctgccagtgccacccagatagcctcacaaaactttgacccagccactgttagtgtcgccaccgcccataaaggagctgagcccagcaggggcactgcctggggccctgtagccaaaaggctacagcaggagctgatgaccctcatgatgcctggtgacaaaagaatttctgcctaccctgaaagccttatcaaatggacaccatccatgaagcagctggcacagtgtatgaagatctgaggtataagctcttgctggagttcctcaatgactacccacctttacgatgcacccacagtgaagttcctcacaccctgctaccaccctaacgtggacacccagggtaacatatgcctggacatcctgaaggagaagtggtctgccccgtatgatatcaggaccatcctgctctctatccagtgcctgctaggacaactcaacattgatagccctttgaacacacatgctaccaagctctgggaaaaccccatagctttaagaagtacctgcaagggtcaggcgcagtggctcacacctgtaatcccagcactttgggaggccgaggtgggtggatggatcacctgacgtagagagtccaaggcctgacaaacatggagaaatgtcatccctatttaaaaaaataaaaaaattagccaagtgtggtggcgcatgcctgtaatcccagctactcgggaggctgaggcaggagaatcacttgaacctgggaggtggaggttgcagtgagccgagatctcgctattgcactccagcctgggcaacaagagtgaaactctgcctcaaaaaaaaataaaataaaataaaaataaaaataaggaagtacctgcaagaaagctactcaaagtaggtcaccagccaggagctctgacccaggctgcccagcctatccttgtgttgtctttttaattttcccttagatggtctgccctttccgtgatttctgtgtagaactctgtatcttgagctgtggtactatttttcttttgtcttttaatttaaatcttgttgggagctcttgtgatgaatattaaatacatacattttgggctgggtgtggtgcctctagcctataatcccagcactttgggaggccgaggcaggcgaatcgtgaggtcaggagatcgagaccatcctgcctaacacggtgaaacctcgtctctactaaaaatacaaaaaaattagccgggcgtggtggcgggtgcctatagtcccagctgctcgggaggctgaggcaggagaatggcatgaacccgggaggtggagcttgcagtgagctgagattgcaccactgcactccaggctgggcacagagcaagactccatctcaaaaaaaaaaaaaaaaaaaagacaaaaagaaaacattttggtcattaaaaaacaaaaaaaaaatgatacgagagagcacccagggattataagaggaaacactttattacatcactcatctaacattccagaaaatggaaagtactctactgtacagcaaagtaaatcattggttgtctggagaacagaaagaaagcctttataaaaaggttccaagtaaatataaaggtgttaagttcattattgtgactatgttaatggtttcatgggattatatgaaactcaagatttatcacatgctacagcttaaatatgcatagcttactgaatgtcatttataactcatcacagctttaaaatatacttcagactggcagcagtggctcacacctgtattcccaccactctgggaggctgaggcaggcatatcacctgaggtcaggagtccaagatcagcctggccaacatggcaaaactccgtctctactaaaaatacaaaacttggccgggcatggtggcacatgcttccagtcccacctacatgggaggctgagcc

SEQ ID NO: 369497 - DNA, 9441 bp, Homo sapiens
  misc_feature (4024)..(4024): n is a, c, g, or t
  misc_feature (6122)..(6122): n is a, c, g, or t
acgtatggtgcagtacattgattgaagtaacatgagagagaaggggtgggtgtagcaaaaacattctcaaggccaagtcatcagcccttacccttaggagggggcagtgattaagaggtggtatgagagcctcgtttctcatttctataagtgctggtaaaggacctgaccccacttccttacctactgcctgcccaggtaactgatgcctacagcatcacaggaattgccaaaatgcagaaaacaaatcctaaattgctctaattccataacacaaaggctggtttttggcttgaaataatcaggcacatatatcatgttctgtcacccagggtggagtgcagtggtgtgatctcggctcactacaaaccccgcctcctgggttcacgccattctccggcctcagcctcccgagtagctgggactacaggtgcccaccaccatgcccggctaattttttgtatttttagtagagacagggtttcaccatgttaaccagcatagtctctatcccctgactgcaagatctgcccgaatcagtgtcccaaagtgctgggattacaggcgtgagccaccgcacccagcccagaagggagtggacctttttatgtcaggacctcagcatggatacctatttgtccacctacttcttgttgctgatggcatttgaccagcaggcccatgaagagacaaaggcaccagtggatgtggtttcaactccgtgttggggaccttgggaggaggatgggcaagggtgggcgtgtgggagaggtgggttgtggtacctcagcagaggggctgcttgtggcttcatctgtcactatcatagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtacacaccaccacgcccagctaatttttgtgtttttagtggagatggggttttaccatgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttggagatcagcctgggcaacatggccagacctcctctctacaaaaagaaaaaagaatgacatgcttcttgtttttgtctgttataaatgaaactgctatatttgaatgcagttgttcatgtaggtatgtttcactatggtaatatggtggtgtgcagtgcctgagtcacgtgatagattaaagtacaactcttttttgagacagagtctcactctgtcacccaggcgggagttaggtggcatgatttcggctcactgcaacctctgcctcccaagttcaactgattcttctgcctcagcctcccgagtagcagggattaccggtgtgcaccaccatgcctggataacttttttttttatttctattagcaatggggtttcaccatgctggccaggcttgttatgaactgacctcaagtgatctgcctgcctcagcttctcaggtgtgacctactgtgcttggcctaatgtacaactttttaagcaatgccaaactatgacttaagaatgaaattattgctcatttgtatatctatctaccatcagtgtccaagaatttctgttctatcttaccaagagggagtatggttagtatttgaaattgtttattattttaataagtggttataacttttgagtcagtggtttatgttttgcattttttttgttttgagacaaagtctcgctctgtctcccaggctagagtaccgtggcacaatctcagctcattgcaacctctgcttcctgggctcaagcactctgcccacctcagcctccagagtagctggaaatacaggtatgcaccaccacaactggataacttttgtattttctgtagagagggttttacctttttgcccagtctgatcgcgaactcctgggctcaggcgatccacttgcctaggctccaaaagtgcttggtctacaggggtgaggcaccctgcctggcctcacctgtaggcttgttttttaaaatgaattttatctatttcccatttcattaatatatttaaaaataatgaaataacaaagacgtatgttggacttcattcattcttcagtgatgtcactttgctgcaaggaatatttggttttcttttttttttttttttccagatggagtctagctctgtctcctaagctacagtgaagtggcatgatctcggcccactgcaacctccacctcctgtgttcaagcgattctgcctcagcctcctgagtagctgggactacnggcatgtgccattatacctggctaattttatttatttattttagtagagatggggtttcaccatgttacccaggctgctctctaccttctgagctcaagtgatccacctgcctcggcctcccaaagtgctgggattacaggtgtcagccactgtacctggctgaatacttggttttcagtaccacaagaactatgagctggttatccacttcatgtggaatcataagcgtcccaaagtgacaatacatatagattgccaggcagtgaaacagttaagatgccaccatagctttcttttcaacatctttctaagattaccttactatttcttttgttccaagtttgtacttcctcacagttctcacatatggaaaggatacacactttgtagaaacaagaactttatgttatccaagttctaggatagccatgagctccaattatctcagagctctgagtcctctactcaatacccattgagatttatgtgttctgaggcttttgtcttctagctacttacttcattctccatgggtaacgtcattcatccacattaactaatttcctcactccaagctcttttctagagataatctccagtccctgtgcagaaactgtcattgcactttctgctgaaatggcagtttcttctcagcaaggtgagattatggaatccagaatcttttttcaggggtcacatgcccatttccccacttgcatgaatgtcgacactgcagccacagttttggccgtaaatgtgaatttggcaagtaaccactgttcccagggaaatgtcccaatcagaagaagattatctgggacactgatactgacagggagatgggacattctgagggacccggaggcagggtgccacctcctcaacttccctgagggctgcctagaatctgtttcctctcactctgaattattcttcctcttatggctgaccaaaaacatggaacctcacaaagtccactgtaacagctttatatttgtgaagtgaagaacatgaagacagtttcaagcaaagttattgagtggacactttgtgttttttttgagaagtctcactctttcacccaggctggagtgcagtggcacgatctcggctcactgcaactccacctcccgggttcacgccattctcttgcctcagcctcctgagtagctgggaccacaagcgcccaccacgtcagcttaatttttttgttttgtttcttgagacagagtcttgctctcttgcccaggttggagtgccgtgtcgcaatctcagctcactgcaacttctacctcctggattcaagcacttctccttgcctcagccacctctttagctgggattacaggtgcgtgccaccacacccagctaatttttgtatttttagcagagaccaggtttcaccatgttggtcaggctggtctcaaactcctgacctcgtgatccacccacctcggcctcccaaagtgctggaattacaggcgtgagccactgcacctggcctgtattcttttctttagtagagacggggttttactgtatttgccaggatggtctcgatctccagacctcgtgatccgcccgccttagcctcccaaagtgctgggattataggcgtgagccaacacgccctggccacttcttgtctttgcaacattttttagatatgtatttgtgttttttggggagcttaatttgctaatggaatctctgttattttcctaacatgcttggtggatacaagagttaagacttcctgtcccgtttagtgtaacaaaagaaagttaagaaatgtggataaaagattgtaagttagaaatggcaagataatcagctatatgaagaatcttggccaggtgtggtggctgaggcctgtaatcccaccactttgggaggctgaggtgggcggatcacaaggtcaggagttcaagaccaccctggacaatattgtgaattcctgtctctactaaaaatacaaaaattagtcgggcatggtggcgggtgcctgtagtcccagagtagctgggcctataggttccctccaccacgcccagctaatttttgtatttttagtagagatgggctttcactacgttngccaggctggtctcaaactcctgacctcatgatccacccccctcggcctcctaaagtgctgggattacaggcatctgccaccgcactcggcttatccctagaaatcctatgatagcatgatgtataggcacctaaaggcatggcacttgagaaatgtgaataagattgtaagttacaaatagcaaggtacagtcagatgttaacagtctcagcccctaaatgtcaccttgtattacagcatgttatataagcacatacaggcacatacatgaaatagtgatacttcattctcagtaatatcttcatccttctcactggaaagatctttgatgatttttaatcaacataggagtttcaatgatatctagaagtttaaaagggctcgttcaaacaaattatgaccacacacactgaagagtatgtttgtctcttgtggtgtaaatttttttttattacaccaaattatgttcacacaaaacctttgtaatcagggggaattaaagagccttcctggaaaatggaggttgcaatcagccgagatggtgccatcgcactctagcctggggaatagagtgagatcctgcctcaaaaaaaacaaaaaaattctttattttctccataaactacagtttatataagcaaaagtttcagtactaagcaattttagtctctgcagtctcttgtcttgaattaatacaacttttgttaattctcttatgaagttaatcttcctgcttgtatgtgaattaaatatatgtcaaactttttttgtacaaaagattcatacctctttcctgtttgaaattattttactgtgtttcatcaatctaatgtttatttttattacaccagtaatttcctcattgtgttgaatcttacagtggcttataaatctacatgtacctagaaatgtttagccagtccatgtatatttgatgtggcacattttttcctttgaatcacatactctaagagaagtaacttcctcttgctaacctctactttccctaagtgttgaattaatcctctttagatgattataattctcttttcaatagctagaaagaatctataaggaactttcctggctgggtgtggtggctcatgcctgtaatcccagcacttcaggaggccgaggtgggtggatcacgaggtcaggagttccagaccagcctgaccaacatggttaaaccatgtctttactaaaaatgcaaaaattagcacctgtaatcccagctactcaggaggctgaggcatagaattgcttgaacctggcaggcagaggtggtgagccgagatcacggcactgcactccagcctgggtgacaagagcaagactccgtctcaaaataaataaataaaaataaaaaataaacatgatgatcacagatgcagtcacattttctgagttcttgtctctctgccagtgccacccagatagcctcacaaaactttgacccagccactgttagtgtcgccaccgcccataaaggagctgagcccagcaggggcactgcctggggccctgtagccaaaaggctacagcaggagctgatgaccctcatgatgcctggtgacaaaagaatttctgcctaccctgaaagccttatcaaatggacaccatccatgaagcagctggcacagtgtatgaagatctgaggtataagctcttgctggagttcctcaatgactacccacctttacgatgcacccacagtgaagttcctcacaccctgctaccaccctaacgtggacacccagggtaacatatgcctggacatcctgaaggagaagtggtctgccccgtatgatatcaggaccatcctgctctctatccagtgcctgctaggacaactcaacattgatagccctttgaacacacatgctaccaagctctgggaaaaccccatagctttaagaagtacctgcaagggtcaggcgcagtggctcacacctgtaatcccagcactttgggaggccgaggtgggtggatggatcacctgacgtagagagtccaaggcctgacaaacatggagaaatgtcatccctatttaaaaaaataaaaaaattagccaagtgtggtggcgcatgcctgtaatcccagctactcgggaggctgaggcaggagaatcacttgaacctgggaggtggaggttgcagtgagccgagatctcgctattgcactccagcctgggcaacaagagtgaaactctgcctcaaaaaaaaataaaataaaataaaaataaaaataaggaagtacctgcaagaaagctactcaaagtaggtcaccagccaggagctctgacccaggctgcccagcctatccttgtgttgtctttttaattttcccttagatggtctgccctttccgtgatttctgtgtagaactctgtatcttgagctgtggtactatttttcttttgtcttttaatttaaatcttgttgggagctcttgtgatgaatattaaatacatacattttgggctgggtgtggtgcctctagcctataatcccagcactttgggaggccgaggcaggcgaatcgtgaggtcaggagatcgagaccatcctgcctaacacggtgaaacctcgtctctactaaaaatacaaaaaaattagccgggcgtggtggcgggtgcctatagtcccagctgctcgggaggctgaggcaggagaatggcatgaacccgggaggtggagcttgcagtgagctgagattgcaccactgcactccaggctgggcacagagcaagactccatctcaaaaaaaaaaaaaaaaaaaagacaaaaagaaaacattttggtcattaaaaaacaaaaaaaaaatgatacgagagagcacccagggattataagaggaaacactttattacatcactcatctaacattccagaaaatggaaagtactctactgtacagcaaagtaaatcattggttgtctggagaacagaaagaaagcctttataaaaaggttccaagtaaatataaaggtgttaagttcattattgtgactatgttaatggtttcatgggattatatgaaactcaagatttatcacatgctacagcttaaatatgcatagcttactgaatgtcatttataactcatcacagctttaaaatatacttcagactggcagcagtggctcacacctgtattcccaccactctgggaggctgaggcaggcatatcacctgaggtcaggagtccaagatcagcctggccaacatggcaaaactccgtctctactaaaaatacaaaacttggccgggcatggtggcacatgcttccagtcccacctacatgggaggctgagcc

SEQ ID NO: 369498 - DNA, 6709 bp, Homo sapiens
  misc_feature (2239)..(2239): n is a, c, g, or t
acttcgacggagactctccagtgtgctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtacacaccaccacgcccagctaatttttgtgtttttagtggagatggggttttaccatgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttggagatcagcctgggcaacatggccagacctcctctctacaaaaagaaaaaagaatgacatgcttcttgtttttgtctgttataaatgaaactgctatatttgaatgcagttgttcatgtaggtatgtttcactatggtaatatggtggtgtgcagtgcctgagtcacgtgatagattaaagtacaactcttttttgagacagagtctcactctgtcacccaggcgggagttaggtggcatgatttcggctcactgcaacctctgcctcccaagttcaactgattcttctgcctcagcctcccgagtagcagggattaccggtgtgcaccaccatgcctggataacttttttttttatttctattagcaatggggtttcaccatgctggccaggcttgttatgaactgacctcaagtgatctgcctgcctcagcttctcaggtgtgacctactgtgcttggcctaatgtacaactttttaagcaatgccaaactatgacttaagaatgaaattattgctcatttgtatatctatctaccatcagtgtccaagaatttctgttctatcttaccaagagggagtatggttagtatttgaaattgtttattattttaataagtggttataacttttgagtcagtggtttatgttttgcattttttttgttttgagacaaagtctcgctctgtctcccaggctagagtaccgtggcacaatctcagctcattgcaacctctgcttcctgggctcaagcactctgcccacctcagcctccagagtagctggaaatacaggtatgcaccaccacaactggataacttttgtattttctgtagagagggttttacctttttgcccagtctgatcgcgaactcctgggctcaggcgatccacttgcctaggctccaaaagtgcttggtctacaggggtgaggcaccctgcctggcctcacctgtaggcttgttttttaaaatgaattttatctatttcccatttcattaatatatttaaaaataatgaaataacaaagacgtatgttggacttcattcattcttcagtgatgtcactttgctgcaaggaatatttggttttcttttttttttttttttccagatggagtctagctctgtctcctaagctacagtgaagtggcatgatctcggcccactgcaacctccacctcctgtgttcaagcgattctgcctcagcctcctgagtagctgggactacnggcatgtgccattatacctggctaattttatttatttattttagtagagatggggtttcaccatgttacccaggctgctctctaccttctgagctcaagtgatccacctgcctcggcctcccaaagtgctgggattacaggtgtcagccactgtacctggctgaatacttggttttcagtaccacaagaactatgagctggttatccacttcatgtggaatcataagcgtcccaaagtgacaatacatatagattgccaggcagtgaaacagttaagatgccaccatagctttcttttcaacatctttctaagattaccttactatttcttttgttccaagtttgtacttcctcacagttctcacatatggaaaggatacacactttgtagaaacaagaactttatgttatccaagttctaggatagccatgagctccaattatctcagagctctgagtcctctactcaatacccattgagatttatgtgttctgaggcttttgtcttctagctacttacttcattctccatgggtaacgtcattcatccacattaactaatttcctcactccaagctcttttctagagataatctccagtccctgtgcagaaactgtcattgcactttctgctgaaatggcagtttcttctcagcaaggtgagattatggaatccagaatcttttttcaggggtcacatgcccatttccccacttgcatgaatgtcgacactgcagccacagttttggccgtaaatgtgaatttggcaagtaaccactgttcccagggaaatgtcccaatcagaagaagattatctgggacactgatactgacagggagatgggacattctgagggacccggaggcagggtgccacctcctcaacttccctgagggctgcctagaatctgtttcctctcactctgaattattcttcctcttatggctgaccaaaaacatggaacctcacaaagtccactgtaacagctttatatttgtgaagtgaagaacatgaagacagtttcaagcaaagttattgagtggacactttgtgttttttttgagaagtctcactctttcacccaggctggagtgcagtggcacgatctcggctcactgcaactccacctcccgggttcacgccattctcttgcctcagcctcctgagtagctgggaccacaagcgcccaccacgtcagcttaatttttttgttttgtttcttgagacagagtcttgctctcttgcccaggttggagtgccgtgtcgcaatctcagctcactgcaacttctacctcctggattcaagcacttctccttgcctcagccacctctttagctgggattacaggtgcgtgccaccacacccagctaattaccttgtattacagcatgttatataagcacatacaggcacatacatgaaatagtgatacttcattctcagtaatatcttcatccttctcactggaaagatctttgatgatttttaatcaacataggagtttcaatgatatctagaagtttaaaagggctcgttcaaacaaattatgaccacacacactgaagagtatgtttgtctcttgtggtgtaaatttttttttattacaccaaattatgttcacacaaaacctttgtaatcagggggaattaaagagccttcctggaaaatggaggttgcaatcagccgagatggtgccatcgcactctagcctggggaatagagtgagatcctgcctcaaaaaaaacaaaaaaattctttattttctccataaactacagtttatataagcaaaagtttcagtactaagcaattttagtctctgcagtctcttgtcttgaattaatacaacttttgttaattctcttatgaagttaatcttcctgcttgtatgtgaattaaatatatgtcaaactttttttgtacaaaagattcatacctctttcctgtttgaaattattttactgtgtttcatcaatctaatgtttatttttattacaccagtaatttcctcattgtgttgaatcttacagtggcttataaatctacatgtacctagaaatgtttagccagtccatgtatatttgatgtggcacattttttcctttgaatcacatactctaagagaagtaacttcctcttgctaacctctactttccctaagtgttgaattaatcctctttagatgattataattctcttttcaatagctagaaagaatctataaggaactttcctggctgggtgtggtggctcatgcctgtaatcccagcacttcaggaggccgaggtgggtggatcacgaggtcaggagttccagaccagcctgaccaacatggttaaaccatgtctttactaaaaatgcaaaaattagcacctgtaatcccagctactcaggaggctgaggcatagaattgcttgaacctggcaggcagaggtggtgagccgagatcacggcactgcactccagcctgggtgacaagagcaagactccgtctcaaaataaataaataaaaataaaaaataaacatgatgatcacagatgcagtcacattttctgagttcttgtctctctgccagtgccacccagatagcctcacaaaactttgacccagccactgttagtgtcgccaccgcccataaaggagctgagcccagcaggggcactgcctggggccctgtagccaaaaggctacagcaggagctgatgaccctcatgatgcctggtgacaaaagaatttctgcctaccctgaaagccttatcaaatggacaccatccatgaagcagctggcacagtgtatgaagatctgaggtataagctcttgctggagttcctcaatgactacccacctttacgatgcacccacagtgaagttcctcacaccctgctaccaccctaacgtggacacccagggtaacatatgcctggacatcctgaaggagaagtggtctgccccgtatgatatcaggaccatcctgctctctatccagtgcctgctaggacaactcaacattgatagccctttgaacacacatgctaccaagctctgggaaaaccccatagctttaagaagtacctgcaagggtcaggcgcagtggctcacacctgtaatcccagcactttgggaggccgaggtgggtggatggatcacctgacgtagagagtccaaggcctgacaaacatggagaaatgtcatccctatttaaaaaaataaaaaaattagccaagtgtggtggcgcatgcctgtaatcccagctactcgggaggctgaggcaggagaatcacttgaacctgggaggtggaggttgcagtgagccgagatctcgctattgcactccagcctgggcaacaagagtgaaactctgcctcaaaaaaaaataaaataaaataaaaataaaaataaggaagtacctgcaagaaagctactcaaagtaggtcaccagccaggagctctgacccaggctgcccagcctatccttgtgttgtctttttaattttcccttagatggtctgccctttccgtgatttctgtgtagaactctgtatcttgagctgtggtactatttttcttttgtcttttaatttaaatcttgttgggagctcttgtgatgaatattaaatacatacattttgggctgggtgtggtgcctctagcctataatcccagcactttgggaggccgaggcaggcgaatcgtgaggtcaggagatcgagaccatcctgcctaacacggtgaaacctcgtctctactaaaaatacaaaaaaattagccgggcgtggtggcgggtgcctatagtcccagctgctcgggaggctgaggcaggagaatggcatgaacccgggaggtggagcttgcagtgagctgagattgcaccactgcactccaggctgggcacagagcaagactccatctcaaaaaaaaaaaaaaaaaaaagacaaaaagaaaacattttggtcattaaaaaacaaaaaaaaaatgatacgagagagcacccagggattataagaggaaacactttattacatcactcatctaacattccagaaaatggaaagtactctactgtacagcaaagtaaatcattggttgtctggagaacagaaagaaagcctttataaaaaggttccaagtaaatataaaggtgttaagttcattattgtgactatgttaatggtttcatgggattatatgaaactcaagatttatcacatgctacagcttaaatatgcatagcttactgaatgtcatttataactcatcacagctttaaaatatacttcagactggcagcagtggctcacacctgtattcccaccactctgggaggctgaggcaggcatatcacctgaggtcaggagtccaagatcagcctggccaacatggcaaaactccgtctctactaaaaatacaaaacttggccgggcatggtggcacatgcttccagtcccacctacatgggaggctgagcc

SEQ ID NO: 369499 - DNA, 5909 bp, Homo sapiens
  misc_feature (61)..(61): n is a, c, g, or t
  misc_feature (87)..(87): n is a, c, g, or t
  misc_feature (1439)..(1439): n is a, c, g, or t
catttaggcctggagactgttaacatctgactgtaccctgctatttgtaacttaccatctnattcacatttctcaagtgccatgccnttaggtgcctatacatcatgctatcataggatttctagggataagccgagtgcggtggcagatgcctgcaatcccagcactttaggaggccgaggggggcggaccatgaggccaggagttggagatcagcctgggcaacatggccagacctcctctctacaaaaagaaaaaagaatgacatgcttcttgtttttgtctgttataaatgaaactgctatatttgaatgcagttgttcatgtaggtatgtttcactatggtaatatggtggtgtgcagtgcctgagtcacgtgatagattaaagtacaactcttttttgagacagagtctcactctgtcacccaggcgggagttaggtggcatgatttcggctcactgcaacctctgcctcccaagttcaactgattcttctgcctcagcctcccgagtagcagggattaccggtgtgcaccaccatgcctggataacttttttttttatttctattagcaatggggtttcaccatgctggccaggcttgttatgaactgacctcaagtgatctgcctgcctcagcttctcaggtgtgacctactgtgcttggcctaatgtacaactttttaagcaatgccaaactatgacttaagaatgaaattattgctcatttgtatatctatctaccatcagtgtccaagaatttctgttctatcttaccaagagggagtatggttagtatttgaaattgtttattattttaataagtggttataacttttgagtcagtggtttatgttttgcattttttttgttttgagacaaagtctcgctctgtctcccaggctagagtaccgtggcacaatctcagctcattgcaacctctgcttcctgggctcaagcactctgcccacctcagcctccagagtagctggaaatacaggtatgcaccaccacaactggataacttttgtattttctgtagagagggttttacctttttgcccagtctgatcgcgaactcctgggctcaggcgatccacttgcctaggctccaaaagtgcttggtctacaggggtgaggcaccctgcctggcctcacctgtaggcttgttttttaaaatgaattttatctatttcccatttcattaatatatttaaaaataatgaaataacaaagacgtatgttggacttcattcattcttcagtgatgtcactttgctgcaaggaatatttggttttcttttttttttttttttccagatggagtctagctctgtctcctaagctacagtgaagtggcatgatctcggcccactgcaacctccacctcctgtgttcaagcgattctgcctcagcctcctgagtagctgggactacnggcatgtgccattatacctggctaattttatttatttattttagtagagatggggtttcaccatgttacccaggctgctctctaccttctgagctcaagtgatccacctgcctcggcctcccaaagtgctgggattacaggtgtcagccactgtacctggctgaatacttggttttcagtaccacaagaactatgagctggttatccacttcatgtggaatcataagcgtcccaaagtgacaatacatatagattgccaggcagtgaaacagttaagatgccaccatagctttcttttcaacatctttctaagattaccttactatttcttttgttccaagtttgtacttcctcacagttctcacatatggaaaggatacacactttgtagaaacaagaactttatgttatccaagttctaggatagccatgagctccaattatctcagagctctgagtcctctactcaatacccattgagatttatgtgttctgaggcttttgtcttctagctacttacttcattctccatgggtaacgtcattcatccacattaactaatttcctcactccaagctcttttctagagataatctccagtccctgtgcagaaactgtcattgcactttctgctgaaatggcagtttcttctcagcaaggtgagattatggaatccagaatcttttttcaggggtcacatgcccatttccccacttgcatgaatgtcgacactgcagccacagttttggccgtaaatgtgaatttggcaagtaaccactgttcccagggaaatgtcccaatcagaagaagattatctgggacactgatactgacagggagatgggacattctgagggacccggaggcagggtgccacctcctcaacttccctgagggctgcctagaatctgtttcctctcactctgaattattcttcctcttatggctgaccaaaaacatggaacctcacaaagtccactgtaacagctttatatttgtgaagtgaagaacatgaagacagtttcaagcaaagttattgagtggacactttgtgttttttttgagaagtctcactctttcacccaggctggagtgcagtggcacgatctcggctcactgcaactccacctcccgggttcacgccattctcttgcctcagcctcctgagtagctgggaccacaagcgcccaccacgtcagcttaatttttttgttttgtttcttgagacagagtcttgctctcttgcccaggttggagtgccgtgtcgcaatctcagctcactgcaacttctacctcctggattcaagcacttctccttgcctcagccacctctttagctgggattacaggtgcgtgccaccacacccagctaattaccttgtattacagcatgttatataagcacatacaggcacatacatgaaatagtgatacttcattctcagtaatatcttcatccttctcactggaaagatctttgatgatttttaatcaacataggagtttcaatgatatctagaagtttaaaagggctcgttcaaacaaattatgaccacacacactgaagagtatgtttgtctcttgtggtgtaaatttttttttattacaccaaattatgttcacacaaaacctttgtaatcagggggaattaaagagccttcctggaaaatggaggttgcaatcagccgagatggtgccatcgcactctagcctggggaatagagtgagatcctgcctcaaaaaaaacaaaaaaattctttattttctccataaactacagtttatataagcaaaagtttcagtactaagcaattttagtctctgcagtctcttgtcttgaattaatacaacttttgttaattctcttatgaagttaatcttcctgcttgtatgtgaattaaatatatgtcaaactttttttgtacaaaagattcatacctctttcctgtttgaaattattttactgtgtttcatcaatctaatgtttatttttattacaccagtaatttcctcattgtgttgaatcttacagtggcttataaatctacatgtacctagaaatgtttagccagtccatgtatatttgatgtggcacattttttcctttgaatcacatactctaagagaagtaacttcctcttgctaacctctactttccctaagtgttgaattaatcctctttagatgattataattctcttttcaatagctagaaagaatctataaggaactttcctggctgggtgtggtggctcatgcctgtaatcccagcacttcaggaggccgaggtgggtggatcacgaggtcaggagttccagaccagcctgaccaacatggttaaaccatgtctttactaaaaatgcaaaaattagcacctgtaatcccagctactcaggaggctgaggcatagaattgcttgaacctggcaggcagaggtggtgagccgagatcacggcactgcactccagcctgggtgacaagagcaagactccgtctcaaaataaataaataaaaataaaaaataaacatgatgatcacagatgcagtcacattttctgagttcttgtctctctgccagtgccacccagatagcctcacaaaactttgacccagccactgttagtgtcgccaccgcccataaaggagctgagcccagcaggggcactgcctggggccctgtagccaaaaggctacagcaggagctgatgaccctcatgatgcctggtgacaaaagaatttctgcctaccctgaaagccttatcaaatggacaccatccatgaagcagctggcacagtgtatgaagatctgaggtataagctcttgctggagttcctcaatgactacccacctttacgatgcacccacagtgaagttcctcacaccctgctaccaccctaacgtggacacccagggtaacatatgcctggacatcctgaaggagaagtggtctgccccgtatgatatcaggaccatcctgctctctatccagtgcctgctaggacaactcaacattgatagccctttgaacacacatgctaccaagctctgggaaaaccccatagctttaagaagtacctgcaagggtcaggcgcagtggctcacacctgtaatcccagcactttgggaggccgaggtgggtggatggatcacctgacgtagagagtccaaggcctgacaaacatggagaaatgtcatccctatttaaaaaaataaaaaaattagccaagtgtggtggcgcatgcctgtaatcccagctactcgggaggctgaggcaggagaatcacttgaacctgggaggtggaggttgcagtgagccgagatctcgctattgcactccagcctgggcaacaagagtgaaactctgcctcaaaaaaaaataaaataaaataaaaataaaaataaggaagtacctgcaagaaagctactcaaagtaggtcaccagccaggagctctgacccaggctgcccagcctatccttgtgttgtctttttaattttcccttagatggtctgccctttccgtgatttctgtgtagaactctgtatcttgagctgtggtactatttttcttttgtcttttaatttaaatcttgttgggagctcttgtgatgaatattaaatacatacattttgggctgggtgtggtgcctctagcctataatcccagcactttgggaggccgaggcaggcgaatcgtgaggtcaggagatcgagaccatcctgcctaacacggtgaaacctcgtctctactaaaaatacaaaaaaattagccgggcgtggtggcgggtgcctatagtcccagctgctcgggaggctgaggcaggagaatggcatgaacccgggaggtggagcttgcagtgagctgagattgcaccactgcactccaggctgggcacagagcaagactccatctcaaaaaaaaaaaaaaaaaaaagacaaaaagaaaacattttggtcattaaaaaacaaaaaaaaaatgatacgagagagcacccagggattataagaggaaacactttattacatcactcatctaacattccagaaaatggaaagtactctactgtacagcaaagtaaatcattggttgtctggagaacagaaagaaagcctttataaaaaggttccaagtaaatataaaggtgttaagttcattattgtgactatgttaatggtttcatgggattatatgaaactcaagatttatcacatgctacagcttaaatatgcatagcttactgaatgtcatttataactcatcacagctttaaaatatacttcagactggcagcagtggctcacacctgtattcccaccactctgggaggctgaggcaggcatatcacctgaggtcaggagtccaagatcagcctggccaacatggcaaaactccgtctctactaaaaatacaaaacttggccgggcatggtggcacatgcttccagtcccacctacatgggaggctgagcc

SEQ ID NO: 369500 - DNA, 8585 bp, Homo sapiens
  misc_feature (4024)..(4024): n is a, c, g, or t
  misc_feature (5266)..(5266): n is a, c, g, or t
acgtatggtgcagtacattgattgaagtaacatgagagagaaggggtgggtgtagcaaaaacattctcaaggccaagtcatcagcccttacccttaggagggggcagtgattaagaggtggtatgagagcctcgtttctcatttctataagtgctggtaaaggacctgaccccacttccttacctactgcctgcccaggtaactgatgcctacagcatcacaggaattgccaaaatgcagaaaacaaatcctaaattgctctaattccataacacaaaggctggtttttggcttgaaataatcaggcacatatatcatgttctgtcacccagggtggagtgcagtggtgtgatctcggctcactacaaaccccgcctcctgggttcacgccattctccggcctcagcctcccgagtagctgggactacaggtgcccaccaccatgcccggctaattttttgtatttttagtagagacagggtttcaccatgttaaccagcatagtctctatcccctgactgcaagatctgcccgaatcagtgtcccaaagtgctgggattacaggcgtgagccaccgcacccagcccagaagggagtggacctttttatgtcaggacctcagcatggatacctatttgtccacctacttcttgttgctgatggcatttgaccagcaggcccatgaagagacaaaggcaccagtggatgtggtttcaactccgtgttggggaccttgggaggaggatgggcaagggtgggcgtgtgggagaggtgggttgtggtacctcagcagaggggctgcttgtggcttcatctgtcactatcatagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtacacaccaccacgcccagctaatttttgtgtttttagtggagatggggttttaccatgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttggagatcagcctgggcaacatggccagacctcctctctacaaaaagaaaaaagaatgacatgcttcttgtttttgtctgttataaatgaaactgctatatttgaatgcagttgttcatgtaggtatgtttcactatggtaatatggtggtgtgcagtgcctgagtcacgtgatagattaaagtacaactcttttttgagacagagtctcactctgtcacccaggcgggagttaggtggcatgatttcggctcactgcaacctctgcctcccaagttcaactgattcttctgcctcagcctcccgagtagcagggattaccggtgtgcaccaccatgcctggataacttttttttttatttctattagcaatggggtttcaccatgctggccaggcttgttatgaactgacctcaagtgatctgcctgcctcagcttctcaggtgtgacctactgtgcttggcctaatgtacaactttttaagcaatgccaaactatgacttaagaatgaaattattgctcatttgtatatctatctaccatcagtgtccaagaatttctgttctatcttaccaagagggagtatggttagtatttgaaattgtttattattttaataagtggttataacttttgagtcagtggtttatgttttgcattttttttgttttgagacaaagtctcgctctgtctcccaggctagagtaccgtggcacaatctcagctcattgcaacctctgcttcctgggctcaagcactctgcccacctcagcctccagagtagctggaaatacaggtatgcaccaccacaactggataacttttgtattttctgtagagagggttttacctttttgcccagtctgatcgcgaactcctgggctcaggcgatccacttgcctaggctccaaaagtgcttggtctacaggggtgaggcaccctgcctggcctcacctgtaggcttgttttttaaaatgaattttatctatttcccatttcattaatatatttaaaaataatgaaataacaaagacgtatgttggacttcattcattcttcagtgatgtcactttgctgcaaggaatatttggttttcttttttttttttttttccagatggagtctagctctgtctcctaagctacagtgaagtggcatgatctcggcccactgcaacctccacctcctgtgttcaagcgattctgcctcagcctcctgagtagctgggactacnggcatgtgccattatacctggctaattttatttatttattttagtagagatggggtttcaccatgttacccaggctgctctctaccttctgagctcaagtgatccacctgcctcggcctcccaaagtgctgggattacaggtgtcagccactgtacctggctgaatacttggttttcagtaccacaagaactatgagctggttatccacttcatgtggaatcataagcgtcccaaagtgacaatacatatagattgccaggcagtgaaacagttaagatgccaccatagctttcttttcaacatctttctaagattaccttactatttcttttgttccaagtttgtacttcctcacagttctcacatatggaaaggatacacactttgtagaaacaagaactttatgttatccaagttctaggatagccatgagctccaattatctcagagctctgagtcctctactcaatacccattgagatttatgtgttctgaggcttttgtcttctagctacttacttcattctccatgggtaacgtcattcatccacattaactaatttcctcactccaagctcttttctagagataatctccagtccctgtgcagaaactgtcattgcactttctgctgaaatggcagtttcttctcagcaaggtgagattatggaatccagaatcttttttcaggggtcacatgcccatttccccacttgcatgaatgtcgacactgcagccacagttttggccgtaaatgtgaatttggcaagtaaccactgttcccagggaaatgtcccaatcagaagaagattatctgggacactgatactgacagggagatgggacattctgagggacccggaggcagggtgccacctcctcaacttccctgagggctgcctagaatctgtttcctctcactctgaattattcttcctcttatggctgaccaaaaacatggaacctcacaaagtccactgtaacagctttatatttgtgaagtgaagaacatgaagacagtttcaagcaaagttattgagtggacactttgtgttttttttgagaagtctcactctttcacccaggctggagtgcagtggcacgatctcggctcactgcaactccacctcgttcaagtgattctcttgcctcagcctcccgagtagctgggcctataggttccctccaccacgcccagctaatttttgtatttttagtagagatgggctttcactacgttngccaggctggtctcaaactcctgacctcatgatccacccccctcggcctcctaaagtgctgggattacaggcatctgccaccgcactcggcttatccctagaaatcctatgatagcatgatgtataggcacctaaaggcatggcacttgagaaatgtgaataagattgtaagttacaaatagcaaggtacagtcagatgttaacagtctcagcccctaaatgtcaccttgtattacagcatgttatataagcacatacaggcacatacatgaaatagtgatacttcattctcagtaatatcttcatccttctcactggaaagatctttgatgatttttaatcaacataggagtttcaatgatatctagaagtttaaaagggctcgttcaaacaaattatgaccacacacactgaagagtatgtttgtctcttgtggtgtaaatttttttttattacaccaaattatgttcacacaaaacctttgtaatcagggggaattaaagagccttcctggaaaatggaggttgcaatcagccgagatggtgccatcgcactctagcctggggaatagagtgagatcctgcctcaaaaaaaacaaaaaaattctttattttctccataaactacagtttatataagcaaaagtttcagtactaagcaattttagtctctgcagtctcttgtcttgaattaatacaacttttgttaattctcttatgaagttaatcttcctgcttgtatgtgaattaaatatatgtcaaactttttttgtacaaaagattcatacctctttcctgtttgaaattattttactgtgtttcatcaatctaatgtttatttttattacaccagtaatttcctcattgtgttgaatcttacagtggcttataaatctacatgtacctagaaatgtttagccagtccatgtatatttgatgtggcacattttttcctttgaatcacatactctaagagaagtaacttcctcttgctaacctctactttccctaagtgttgaattaatcctctttagatgattataattctcttttcaatagctagaaagaatctataaggaactttcctggctgggtgtggtggctcatgcctgtaatcccagcacttcaggaggccgaggtgggtggatcacgaggtcaggagttccagaccagcctgaccaacatggttaaaccatgtctttactaaaaatgcaaaaattagcacctgtaatcccagctactcaggaggctgaggcatagaattgcttgaacctggcaggcagaggtggtgagccgagatcacggcactgcactccagcctgggtgacaagagcaagactccgtctcaaaataaataaataaaaataaaaaataaacatgatgatcacagatgcagtcacattttctgagttcttgtctctctgccagtgccacccagatagcctcacaaaactttgacccagccactgttagtgtcgccaccgcccataaaggagctgagcccagcaggggcactgcctggggccctgtagccaaaaggctacagcaggagctgatgaccctcatgatgcctggtgacaaaagaatttctgcctaccctgaaagccttatcaaatggacaccatccatgaagcagctggcacagtgtatgaagatctgaggtataagctcttgctggagttcctcaatgactacccacctttacgatgcacccacagtgaagttcctcacaccctgctaccaccctaacgtggacacccagggtaacatatgcctggacatcctgaaggagaagtggtctgccccgtatgatatcaggaccatcctgctctctatccagtgcctgctaggacaactcaacattgatagccctttgaacacacatgctaccaagctctgggaaaaccccatagctttaagaagtacctgcaagggtcaggcgcagtggctcacacctgtaatcccagcactttgggaggccgaggtgggtggatggatcacctgacgtagagagtccaaggcctgacaaacatggagaaatgtcatccctatttaaaaaaataaaaaaattagccaagtgtggtggcgcatgcctgtaatcccagctactcgggaggctgaggcaggagaatcacttgaacctgggaggtggaggttgcagtgagccgagatctcgctattgcactccagcctgggcaacaagagtgaaactctgcctcaaaaaaaaataaaataaaataaaaataaaaataaggaagtacctgcaagaaagctactcaaagtaggtcaccagccaggagctctgacccaggctgcccagcctatccttgtgttgtctttttaattttcccttagatggtctgccctttccgtgatttctgtgtagaactctgtatcttgagctgtggtactatttttcttttgtcttttaatttaaatcttgttgggagctcttgtgatgaatattaaatacatacattttgggctgggtgtggtgcctctagcctataatcccagcactttgggaggccgaggcaggcgaatcgtgaggtcaggagatcgagaccatcctgcctaacacggtgaaacctcgtctctactaaaaatacaaaaaaattagccgggcgtggtggcgggtgcctatagtcccagctgctcgggaggctgaggcaggagaatggcatgaacccgggaggtggagcttgcagtgagctgagattgcaccactgcactccaggctgggcacagagcaagactccatctcaaaaaaaaaaaaaaaaaaaagacaaaaagaaaacattttggtcattaaaaaacaaaaaaaaaatgatacgagagagcacccagggattataagaggaaacactttattacatcactcatctaacattccagaaaatggaaagtactctactgtacagcaaagtaaatcattggttgtctggagaacagaaagaaagcctttataaaaaggttccaagtaaatataaaggtgttaagttcattattgtgactatgttaatggtttcatgggattatatgaaactcaagatttatcacatgctacagcttaaatatgcatagcttactgaatgtcatttataactcatcacagctttaaaatatacttcagactggcagcagtggctcacacctgtattcccaccactctgggaggctgaggcaggcatatcacctgaggtcaggagtccaagatcagcctggccaacatggcaaaactccgtctctactaaaaatacaaaacttggccgggcatggtggcacatgcttccagtcccacctacatgggaggctgagcc

SEQ ID NO: 369501 - DNA, 8554 bp, Homo sapiens
  misc_feature (4024)..(4024): n is a, c, g, or t
  misc_feature (5235)..(5235): n is a, c, g, or t
acgtatggtgcagtacattgattgaagtaacatgagagagaaggggtgggtgtagcaaaaacattctcaaggccaagtcatcagcccttacccttaggagggggcagtgattaagaggtggtatgagagcctcgtttctcatttctataagtgctggtaaaggacctgaccccacttccttacctactgcctgcccaggtaactgatgcctacagcatcacaggaattgccaaaatgcagaaaacaaatcctaaattgctctaattccataacacaaaggctggtttttggcttgaaataatcaggcacatatatcatgttctgtcacccagggtggagtgcagtggtgtgatctcggctcactacaaaccccgcctcctgggttcacgccattctccggcctcagcctcccgagtagctgggactacaggtgcccaccaccatgcccggctaattttttgtatttttagtagagacagggtttcaccatgttaaccagcatagtctctatcccctgactgcaagatctgcccgaatcagtgtcccaaagtgctgggattacaggcgtgagccaccgcacccagcccagaagggagtggacctttttatgtcaggacctcagcatggatacctatttgtccacctacttcttgttgctgatggcatttgaccagcaggcccatgaagagacaaaggcaccagtggatgtggtttcaactccgtgttggggaccttgggaggaggatgggcaagggtgggcgtgtgggagaggtgggttgtggtacctcagcagaggggctgcttgtggcttcatctgtcactatcatagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtacacaccaccacgcccagctaatttttgtgtttttagtggagatggggttttaccatgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttggagatcagcctgggcaacatggccagacctcctctctacaaaaagaaaaaagaatgacatgcttcttgtttttgtctgttataaatgaaactgctatatttgaatgcagttgttcatgtaggtatgtttcactatggtaatatggtggtgtgcagtgcctgagtcacgtgatagattaaagtacaactcttttttgagacagagtctcactctgtcacccaggcgggagttaggtggcatgatttcggctcactgcaacctctgcctcccaagttcaactgattcttctgcctcagcctcccgagtagcagggattaccggtgtgcaccaccatgcctggataacttttttttttatttctattagcaatggggtttcaccatgctggccaggcttgttatgaactgacctcaagtgatctgcctgcctcagcttctcaggtgtgacctactgtgcttggcctaatgtacaactttttaagcaatgccaaactatgacttaagaatgaaattattgctcatttgtatatctatctaccatcagtgtccaagaatttctgttctatcttaccaagagggagtatggttagtatttgaaattgtttattattttaataagtggttataacttttgagtcagtggtttatgttttgcattttttttgttttgagacaaagtctcgctctgtctcccaggctagagtaccgtggcacaatctcagctcattgcaacctctgcttcctgggctcaagcactctgcccacctcagcctccagagtagctggaaatacaggtatgcaccaccacaactggataacttttgtattttctgtagagagggttttacctttttgcccagtctgatcgcgaactcctgggctcaggcgatccacttgcctaggctccaaaagtgcttggtctacaggggtgaggcaccctgcctggcctcacctgtaggcttgttttttaaaatgaattttatctatttcccatttcattaatatatttaaaaataatgaaataacaaagacgtatgttggacttcattcattcttcagtgatgtcactttgctgcaaggaatatttggttttcttttttttttttttttccagatggagtctagctctgtctcctaagctacagtgaagtggcatgatctcggcccactgcaacctccacctcctgtgttcaagcgattctgcctcagcctcctgagtagctgggactacnggcatgtgccattatacctggctaattttatttatttattttagtagagatggggtttcaccatgttacccaggctgctctctaccttctgagctcaagtgatccacctgcctcggcctcccaaagtgctgggattacaggtgtcagccactgtacctggctgaatacttggttttcagtaccacaagaactatgagctggttatccacttcatgtggaatcataagcgtcccaaagtgacaatacatatagattgccaggcagtgaaacagttaagatgccaccatagctttcttttcaacatctttctaagattaccttactatttcttttgttccaagtttgtacttcctcacagttctcacatatggaaaggatacacactttgtagaaacaagaactttatgttatccaagttctaggatagccatgagctccaattatctcagagctctgagtcctctactcaatacccattgagatttatgtgttctgaggcttttgtcttctagctacttacttcattctccatgggtaacgtcattcatccacattaactaatttcctcactccaagctcttttctagagataatctccagtccctgtgcagaaactgtcattgcactttctgctgaaatggcagtttcttctcagcaaggtgagattatggaatccagaatcttttttcaggggtcacatgcccatttccccacttgcatgaatgtcgacactgcagccacagttttggccgtaaatgtgaatttggcaagtaaccactgttcccagggaaatgtcccaatcagaagaagattatctgggacactgatactgacagggagatgggacattctgagggacccggaggcagggtgccacctcctcaacttccctgagggctgcctagaatctgtttcctctcactctgaattattcttcctcttatggctgaccaaaaacatggaacctcacaaagtccactgtaacagctttatatttgtgaagtgaagaacatgaagacagtttcaagcaaagttattgagtggacactttgtgttttttttgagaagtctcactctttcacccaggctggagtgcagtggcacgatctcggctcactgcaactccacctcagtagctgggcctataggttccctccaccacgcccagctaatttttgtatttttagtagagatgggctttcactacgttngccaggctggtctcaaactcctgacctcatgatccacccccctcggcctcctaaagtgctgggattacaggcatctgccaccgcactcggcttatccctagaaatcctatgatagcatgatgtataggcacctaaaggcatggcacttgagaaatgtgaataagattgtaagttacaaatagcaaggtacagtcagatgttaacagtctcagcccctaaatgtcaccttgtattacagcatgttatataagcacatacaggcacatacatgaaatagtgatacttcattctcagtaatatcttcatccttctcactggaaagatctttgatgatttttaatcaacataggagtttcaatgatatctagaagtttaaaagggctcgttcaaacaaattatgaccacacacactgaagagtatgtttgtctcttgtggtgtaaatttttttttattacaccaaattatgttcacacaaaacctttgtaatcagggggaattaaagagccttcctggaaaatggaggttgcaatcagccgagatggtgccatcgcactctagcctggggaatagagtgagatcctgcctcaaaaaaaacaaaaaaattctttattttctccataaactacagtttatataagcaaaagtttcagtactaagcaattttagtctctgcagtctcttgtcttgaattaatacaacttttgttaattctcttatgaagttaatcttcctgcttgtatgtgaattaaatatatgtcaaactttttttgtacaaaagattcatacctctttcctgtttgaaattattttactgtgtttcatcaatctaatgtttatttttattacaccagtaatttcctcattgtgttgaatcttacagtggcttataaatctacatgtacctagaaatgtttagccagtccatgtatatttgatgtggcacattttttcctttgaatcacatactctaagagaagtaacttcctcttgctaacctctactttccctaagtgttgaattaatcctctttagatgattataattctcttttcaatagctagaaagaatctataaggaactttcctggctgggtgtggtggctcatgcctgtaatcccagcacttcaggaggccgaggtgggtggatcacgaggtcaggagttccagaccagcctgaccaacatggttaaaccatgtctttactaaaaatgcaaaaattagcacctgtaatcccagctactcaggaggctgaggcatagaattgcttgaacctggcaggcagaggtggtgagccgagatcacggcactgcactccagcctgggtgacaagagcaagactccgtctcaaaataaataaataaaaataaaaaataaacatgatgatcacagatgcagtcacattttctgagttcttgtctctctgccagtgccacccagatagcctcacaaaactttgacccagccactgttagtgtcgccaccgcccataaaggagctgagcccagcaggggcactgcctggggccctgtagccaaaaggctacagcaggagctgatgaccctcatgatgcctggtgacaaaagaatttctgcctaccctgaaagccttatcaaatggacaccatccatgaagcagctggcacagtgtatgaagatctgaggtataagctcttgctggagttcctcaatgactacccacctttacgatgcacccacagtgaagttcctcacaccctgctaccaccctaacgtggacacccagggtaacatatgcctggacatcctgaaggagaagtggtctgccccgtatgatatcaggaccatcctgctctctatccagtgcctgctaggacaactcaacattgatagccctttgaacacacatgctaccaagctctgggaaaaccccatagctttaagaagtacctgcaagggtcaggcgcagtggctcacacctgtaatcccagcactttgggaggccgaggtgggtggatggatcacctgacgtagagagtccaaggcctgacaaacatggagaaatgtcatccctatttaaaaaaataaaaaaattagccaagtgtggtggcgcatgcctgtaatcccagctactcgggaggctgaggcaggagaatcacttgaacctgggaggtggaggttgcagtgagccgagatctcgctattgcactccagcctgggcaacaagagtgaaactctgcctcaaaaaaaaataaaataaaataaaaataaaaataaggaagtacctgcaagaaagctactcaaagtaggtcaccagccaggagctctgacccaggctgcccagcctatccttgtgttgtctttttaattttcccttagatggtctgccctttccgtgatttctgtgtagaactctgtatcttgagctgtggtactatttttcttttgtcttttaatttaaatcttgttgggagctcttgtgatgaatattaaatacatacattttgggctgggtgtggtgcctctagcctataatcccagcactttgggaggccgaggcaggcgaatcgtgaggtcaggagatcgagaccatcctgcctaacacggtgaaacctcgtctctactaaaaatacaaaaaaattagccgggcgtggtggcgggtgcctatagtcccagctgctcgggaggctgaggcaggagaatggcatgaacccgggaggtggagcttgcagtgagctgagattgcaccactgcactccaggctgggcacagagcaagactccatctcaaaaaaaaaaaaaaaaaaaagacaaaaagaaaacattttggtcattaaaaaacaaaaaaaaaatgatacgagagagcacccagggattataagaggaaacactttattacatcactcatctaacattccagaaaatggaaagtactctactgtacagcaaagtaaatcattggttgtctggagaacagaaagaaagcctttataaaaaggttccaagtaaatataaaggtgttaagttcattattgtgactatgttaatggtttcatgggattatatgaaactcaagatttatcacatgctacagcttaaatatgcatagcttactgaatgtcatttataactcatcacagctttaaaatatacttcagactggcagcagtggctcacacctgtattcccaccactctgggaggctgaggcaggcatatcacctgaggtcaggagtccaagatcagcctggccaacatggcaaaactccgtctctactaaaaatacaaaacttggccgggcatggtggcacatgcttccagtcccacctacatgggaggctgagcc

SEQ ID NO: 369502 - DNA, 6082 bp, Homo sapiens
  misc_feature (4024)..(4024): n is a, c, g, or t
acgtatggtgcagtacattgattgaagtaacatgagagagaaggggtgggtgtagcaaaaacattctcaaggccaagtcatcagcccttacccttaggagggggcagtgattaagaggtggtatgagagcctcgtttctcatttctataagtgctggtaaaggacctgaccccacttccttacctactgcctgcccaggtaactgatgcctacagcatcacaggaattgccaaaatgcagaaaacaaatcctaaattgctctaattccataacacaaaggctggtttttggcttgaaataatcaggcacatatatcatgttctgtcacccagggtggagtgcagtggtgtgatctcggctcactacaaaccccgcctcctgggttcacgccattctccggcctcagcctcccgagtagctgggactacaggtgcccaccaccatgcccggctaattttttgtatttttagtagagacagggtttcaccatgttaaccagcatagtctctatcccctgactgcaagatctgcccgaatcagtgtcccaaagtgctgggattacaggcgtgagccaccgcacccagcccagaagggagtggacctttttatgtcaggacctcagcatggatacctatttgtccacctacttcttgttgctgatggcatttgaccagcaggcccatgaagagacaaaggcaccagtggatgtggtttcaactccgtgttggggaccttgggaggaggatgggcaagggtgggcgtgtgggagaggtgggttgtggtacctcagcagaggggctgcttgtggcttcatctgtcactatcatagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtacacaccaccacgcccagctaatttttgtgtttttagtggagatggggttttaccatgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttggagatcagcctgggcaacatggccagacctcctctctacaaaaagaaaaaagaatgacatgcttcttgtttttgtctgttataaatgaaactgctatatttgaatgcagttgttcatgtaggtatgtttcactatggtaatatggtggtgtgcagtgcctgagtcacgtgatagattaaagtacaactcttttttgagacagagtctcactctgtcacccaggcgggagttaggtggcatgatttcggctcactgcaacctctgcctcccaagttcaactgattcttctgcctcagcctcccgagtagcagggattaccggtgtgcaccaccatgcctggataacttttttttttatttctattagcaatggggtttcaccatgctggccaggcttgttatgaactgacctcaagtgatctgcctgcctcagcttctcaggtgtgacctactgtgcttggcctaatgtacaactttttaagcaatgccaaactatgacttaagaatgaaattattgctcatttgtatatctatctaccatcagtgtccaagaatttctgttctatcttaccaagagggagtatggttagtatttgaaattgtttattattttaataagtggttataacttttgagtcagtggtttatgttttgcattttttttgttttgagacaaagtctcgctctgtctcccaggctagagtaccgtggcacaatctcagctcattgcaacctctgcttcctgggctcaagcactctgcccacctcagcctccagagtagctggaaatacaggtatgcaccaccacaactggataacttttgtattttctgtagagagggttttacctttttgcccagtctgatcgcgaactcctgggctcaggcgatccacttgcctaggctccaaaagtgcttggtctacaggggtgaggcaccctgcctggcctcacctgtaggcttgttttttaaaatgaattttatctatttcccatttcattaatatatttaaaaataatgaaataacaaagacgtatgttggacttcattcattcttcagtgatgtcactttgctgcaaggaatatttggttttcttttttttttttttttccagatggagtctagctctgtctcctaagctacagtgaagtggcatgatctcggcccactgcaacctccacctcctgtgttcaagcgattctgcctcagcctcctgagtagctgggactacnggcatgtgccattatacctggctaattttatttatttattttagtagagatggggtttcaccatgttacccaggctgctctctaccttctgagctcaagtgatccacctgcctcggcctcccaaagtgctgggattacaggtgtcagccactgtacctggctgaatacttggttttcagtaccacaagaactatgagctggttatccacttcatgtggaatcataagcgtcccaaagtgacaatacatatagattgccaggcagtgaaacagttaagatgccaccatagctttcttttcaacatctttctaagattaccttactatttcttttgttccaagtttgtacttcctcacagttctcacatatggaaaggatacacactttgtagaaacaagaactttatgttatccaagttctaggatagccatgagctccaattatctcagagctctgagtcctctactcaatacccattgagatttatgtgttctgaggcttttgtcttctagctacttacttcattctccatgggtaacgtcattcatccacattaactaatttcctcactccaagctcttttctagagataatctccagtccctgtgcagaaactgtcattgcactttctgctgaaatggcagtttcttctcagcaaggtgagattatggaatccagaatcttttttcaggggtcacatgcccatttccccacttgcatgaatgtcgacactgcagccacagttttggccgtaaatgtgaatttggcaagtaaccactgttcccagggaaatgtcccaatcagaagaagattatctgggacactgatactgacagggagatgggacattctgagggacccggaggcagggtgccacctcctcaacttccctgagggctgcctagaatctgtttcctctcactctgaattattcttcctcttatggctgaccaaaaacatggaacctcacaaagtccactgtaacagctttatatttgtgaagtgaagaacatgaagacagtttcaagcaaagttattgagtggacactttgtgttttttttgagaagtctcactctttcacccaggctggagtgcagtggcacgatctcggctcactgcaactccacctcccgggttcacgccattctcttgcctcagcctcctgagtagctgggaccacaagcgcccaccacgtcagcttaatttttttgttttgtttcttgagacagagtcttgctctcttgcccaggttggagtgccgtgtcgcaatctcagctcactgcaacttctacctcctggattcaagcacttctccttgcctcagccacctctttagctgggattacaggtgcgtgccaccacacccagctaattaccttgtattacagcatgttatataagcacatacaggcacatacatgaaatagtgatacttcattctcagtaatatcttcatccttctcactggaaagatctttgatgatttttaatcaacataggagtttcaatgatatctagaagtttaaaagggctcgttcaaacaaattatgaccacacacactgaagagtatgtttgtctcttgtggtgtaaatttttttttattacaccaaattatgttcacacaaaacctttgtaatcagggggaattaaagagccttcctggaaaatggaggttgcaatcagccgagatggtgccatcgcactctagcctggggaatagagtgagatcctgcctcaaaaaaaacaaaaaaattctttattttctccataaactacagtttatataagcaaaagtttcagtactaagcaattttagtctctgcagtctcttgtcttgaattaatacaacttttgttaattctcttatgaagttaatcttcctgcttgtatgtgaattaaatatatgtcaaactttttttgtacaaaagattcatacctctttcctgtttgaaattattttactgtgtttcatcaatctaatgtttatttttattacaccagtaatttcctcattgtgttgaatcttacagtggcttataaatctacatgtacctag

SEQ ID NO: 369503 - DNA, 5749 bp, Homo sapiens
  misc_feature (2430)..(2430): n is a, c, g, or t
gattctcctgcctcagcctcctgagtagctgggattacaggcatgtaccaccacactcggctaatttttctatttttagtaaagtcggggtttcaccatgttggccaggctagtctcaaactcctgacctcaggagattcgctggcctctgcctccccaagtgctgggattataggcacgagccaccatgccttgcagacagctagattttctaatgtggatgataggagcatgaaagaggaatcgggcatgagcccaaggtttttgatcttagcagctgtaaccatgcacactgcttcagctgagatgacgttggtattgacataatattcactgtggatatccagagggttgttttggccatatgaagaatcagagaccaataagtggtggcatcaaatcgataactagacatactggatggggtatctgggagggtgttgatactggagacatccaatatatgaaagctaatgagtgaactatgattagttatgggtccatttaggaggacatgcttcagattatggtggtaaatcttttcagggggcagaaaggtgtgattacaggctgaggactggatctcttacttacgtcctcaattgatgttattgggcttcctaaacacctgagagggtgtgagtgaccatcataacaggacatttaatacagtagagtttggaaggggacatagacatccaaagagataatagagaagagatagatgcatgcagaagcacaggagtaattcagggaagatgacacttaggcctgagttggtgccaaagttgtaacttttttgttttttttttttcagatggagtttcgctcttgttgcccaaagctacttacttcattctccatgggtaacgtcattcatccacattaactaatttcctcactccaagctcttttctagagataatctccagtccctgtgcagaaactgtcattgcactttctgctgaaatggcagtttcttctcagcaaggtgagattatggaatccagaatcttttttcaggggtcacatgcccatttccccacttgcatgaatgtcgacactgcagccacagttttggccgtaaatgtgaatttggcaagtaaccactgttcccagggaaatgtcccaatcagaagaagattatctgggacactgatactgacagggagatgggacattctgagggacccggaggcagggtgccacctcctcaacttccctgagggctgcctagaatctgtttcctctcactctgaattattcttcctcttatggctgaccaaaaacatggaacctcacaaagtccactgtaacagctttatatttgtgaagtgaagaacatgaagacagtttcaagcaaagttattgagtggacactttgtgttttttttgagaagtctcactctttcacccaggctggagtgcagtggcacgatctcggctcactgcaactccacctcccgggttcacgccattctcttgcctcagcctcctgagtagctgggaccacaagcgcccaccacgtcagcttaatttttttgttttgtttcttgagacagagtcttgctctcttgcccaggttggagtgccgtgtcgcaatctcagctcactgcaacttctacctcctggattcaagcacttctccttgcctcagccacctctttagctgggattacaggtgcgtgccaccacacccagctaatttttgtatttttagcagagaccaggtttcaccatgttggtcaggctggtctcaaactcctgacctcgtgatccacccacctcggcctcccaaagtgctggaattacaggcgtgagccactgcacctggcctgtattcttttctttagtagagacggggttttactgtatttgccaggatggtctcgatctccagacctcgtgatccgcccgccttagcctcccaaagtgctgggattataggcgtgagccaacacgccctggccacttcttgtctttgcaacattttttagatatgtatttgtgttttttggggagcttaatttgctaatggaatctctgttattttcctaacatgcttggtggatacaagagttaagacttcctgtcccgtttagtgtaacaaaagaaagttaagaaatgtggataaaagattgtaagttagaaatggcaagataatcagctatatgaagaatcttggccaggtgtggtggctgaggcctgtaatcccaccactttgggaggctgaggtgggcggatcacaaggtcaggagttcaagaccaccctggacaatattgtgaattcctgtctctactaaaaatacaaaaattagtcgggcatggtggcgggtgcctgtagtcccagagtagctgggcctataggttccctccaccacgcccagctaatttttgtatttttagtagagatgggctttcactacgttngccaggctggtctcaaactcctgacctcatgatccacccccctcggcctcctaaagtgctgggattacaggcatctgccaccgcactcggcttatccctagaaatcctatgatagcatgatgtataggcacctaaaggcatggcacttgagaaatgtgaataagattgtaagttacaaatagcaaggtacagtcagatgttaacagtctcagcccctaaatgtcaccttgtattacagcatgttatataagcacatacaggcacatacatgaaatagtgatacttcattctcagtaatatcttcatccttctcactggaaagatctttgatgatttttaatcaacataggagtttcaatgatatctagaagtttaaaagggctcgttcaaacaaattatgaccacacacactgaagagtatgtttgtctcttgtggtgtaaatttttttttattacaccaaattatgttcacacaaaacctttgtaatcagggggaattaaagagccttcctggaaaatggaggttgcaatcagccgagatggtgccatcgcactctagcctggggaatagagtgagatcctgcctcaaaaaaaacaaaaaaattctttattttctccataaactacagtttatataagcaaaagtttcagtactaagcaattttagtctctgcagtctcttgtcttgaattaatacaacttttgttaattctcttatgaagttaatcttcctgcttgtatgtgaattaaatatatgtcaaactttttttgtacaaaagattcatacctctttcctgtttgaaattattttactgtgtttcatcaatctaatgtttatttttattacaccagtaatttcctcattgtgttgaatcttacagtggcttataaatctacatgtacctagaaatgtttagccagtccatgtatatttgatgtggcacattttttcctttgaatcacatactctaagagaagtaacttcctcttgctaacctctactttccctaagtgttgaattaatcctctttagatgattataattctcttttcaatagctagaaagaatctataaggaactttcctggctgggtgtggtggctcatgcctgtaatcccagcacttcaggaggccgaggtgggtggatcacgaggtcaggagttccagaccagcctgaccaacatggttaaaccatgtctttactaaaaatgcaaaaattagcacctgtaatcccagctactcaggaggctgaggcatagaattgcttgaacctggcaggcagaggtggtgagccgagatcacggcactgcactccagcctgggtgacaagagcaagactccgtctcaaaataaataaataaaaataaaaaataaacatgatgatcacagatgcagtcacattttctgagttcttgtctctctgccagtgccacccagatagcctcacaaaactttgacccagccactgttagtgtcgccaccgcccataaaggagctgagcccagcaggggcactgcctggggccctgtagccaaaaggctacagcaggagctgatgaccctcatgatgcctggtgacaaaagaatttctgcctaccctgaaagccttatcaaatggacaccatccatgaagcagctggcacagtgtatgaagatctgaggtataagctcttgctggagttcctcaatgactacccacctttacgatgcacccacagtgaagttcctcacaccctgctaccaccctaacgtggacacccagggtaacatatgcctggacatcctgaaggagaagtggtctgccccgtatgatatcaggaccatcctgctctctatccagtgcctgctaggacaactcaacattgatagccctttgaacacacatgctaccaagctctgggaaaaccccatagctttaagaagtacctgcaagggtcaggcgcagtggctcacacctgtaatcccagcactttgggaggccgaggtgggtggatggatcacctgacgtagagagtccaaggcctgacaaacatggagaaatgtcatccctatttaaaaaaataaaaaaattagccaagtgtggtggcgcatgcctgtaatcccagctactcgggaggctgaggcaggagaatcacttgaacctgggaggtggaggttgcagtgagccgagatctcgctattgcactccagcctgggcaacaagagtgaaactctgcctcaaaaaaaaataaaataaaataaaaataaaaataaggaagtacctgcaagaaagctactcaaagtaggtcaccagccaggagctctgacccaggctgcccagcctatccttgtgttgtctttttaattttcccttagatggtctgccctttccgtgatttctgtgtagaactctgtatcttgagctgtggtactatttttcttttgtcttttaatttaaatcttgttgggagctcttgtgatgaatattaaatacatacattttgggctgggtgtggtgcctctagcctataatcccagcactttgggaggccgaggcaggcgaatcgtgaggtcaggagatcgagaccatcctgcctaacacggtgaaacctcgtctctactaaaaatacaaaaaaattagccgggcgtggtggcgggtgcctatagtcccagctgctcgggaggctgaggcaggagaatggcatgaacccgggaggtggagcttgcagtgagctgagattgcaccactgcactccaggctgggcacagagcaagactccatctcaaaaaaaaaaaaaaaaaaaagacaaaaagaaaacattttggtcattaaaaaacaaaaaaaaaatgatacgagagagcacccagggattataagaggaaacactttattacatcactcatctaacattccagaaaatggaaagtactctactgtacagcaaagtaaatcattggttgtctggagaacagaaagaaagcctttataaaaaggttccaagtaaatataaaggtgttaagttcattattgtgactatgttaatggtttcatgggattatatgaaactcaagatttatcacatgctacagcttaaatatgcatagcttactgaatgtcatttataactcatcacagctttaaaatatacttcagactggcagcagtggctcacacctgtattcccaccactctgggaggctgaggcaggcatatcacctgaggtcaggagtccaagatcagcctggccaacatggcaaaactccgtctctactaaaaatacaaaacttggccgggcatggtggcacatgcttccagtcccacctacatgggaggctgagcc

SEQ ID NO: 369504 - DNA, 3990 bp, Homo sapiens
  misc_feature (558)..(558): n is a, c, g, or t
gcactccttggtaatcatataggtggtagagatgacactttgtgctgagacacgcaggttagattatcgtccaaggtcacctggctccgcggaacacaaaagcgtacagggaggcctgagcttaccagatcctatcagggacacagtcctgtaaagtcagcctcttccctcaggcctttatggctgtagaagcatttaaggaacgcatacaagaaagtggagggtggggccgggtgcggtggctcacatctgtaatcccagcactttgggagtccaaggtgggtggatcacaaagtcaggagtttgagaccagcctggccaatatggtgaaaccccgtctctactaaaaatacaaaaattagcacctgtaatcacagctactcaggaggctgaggcaggagaattacttgaacctgggaggcagaggttgcagtgagccgaaatcatgccacctaactcccgcctgggtgacagagtgagactctgtctcaaaaaagagttgtactttaatctatcacgtgactcaggcactgcacaccaccatattaccatagtganacatacctacatgaacaactgcattcaaatatagcagtttcatttataacagacaaaaacaagaagcatgtcattcttttttctttttgtagagaggaggtctggccatgttgcccaggctggtctcaaactcctgacctcatgatccacccccctcggcctcctaaagtgctgggattacaggcatctgccaccgcactcggcttatccctagaaatcctatgatagcatgatgtataggcacctaaaggcatggcacttgagaaatgtgaataagattgtaagttacaaatagcaaggtacagtcagatgttaacagtctcagcccctaaatgtcaccttgtattacagcatgttatataagcacatacaggcacatacatgaaatagtgatacttcattctcagtaatatcttcatccttctcactggaaagatctttgatgatttttaatcaacataggagtttcaatgatatctagaagtttaaaagggctcgttcaaacaaattatgaccacacacactgaagagtatgtttgtctcttgtggtgtaaatttttttttattacaccaaattatgttcacacaaaacctttgtaatcagggggaattaaagagccttcctggaaaatggaggttgcaatcagccgagatggtgccatcgcactctagcctggggaatagagtgagatcctgcctcaaaaaaaacaaaaaaattctttattttctccataaactacagtttatataagcaaaagtttcagtactaagcaattttagtctctgcagtctcttgtcttgaattaatacaacttttgttaattctcttatgaagttaatcttcctgcttgtatgtgaattaaatatatgtcaaactttttttgtacaaaagattcatacctctttcctgtttgaaattattttactgtgtttcatcaatctaatgtttatttttattacaccagtaatttcctcattgtgttgaatcttacagtggcttataaatctacatgtacctagaaatgtttagccagtccatgtatatttgatgtggcacattttttcctttgaatcacatactctaagagaagtaacttcctcttgctaacctctactttccctaagtgttgaattaatcctctttagatgattataattctcttttcaatagctagaaagaatctataaggaactttcctggctgggtgtggtggctcatgcctgtaatcccagcacttcaggaggccgaggtgggtggatcacgaggtcaggagttccagaccagcctgaccaacatggttaaaccatgtctttactaaaaatgcaaaaattagcacctgtaatcccagctactcaggaggctgaggcatagaattgcttgaacctggcaggcagaggtggtgagccgagatcacggcactgcactccagcctgggtgacaagagcaagactccgtctcaaaataaataaataaaaataaaaaataaacatgatgatcacagatgcagtcacattttctgagttcttgtctctctgccagtgccacccagatagcctcacaaaactttgacccagccactgttagtgtcgccaccgcccataaaggagctgagcccagcaggggcactgcctggggccctgtagccaaaaggctacagcaggagctgatgaccctcatgatgcctggtgacaaaagaatttctgcctaccctgaaagccttatcaaatggacaccatccatgaagcagctggcacagtgtatgaagatctgaggtataagctcttgctggagttcctcaatgactacccacctttacgatgcacccacagtgaagttcctcacaccctgctaccaccctaacgtggacacccagggtaacatatgcctggacatcctgaaggagaagtggtctgccccgtatgatatcaggaccatcctgctctctatccagtgcctgctaggacaactcaacattgatagccctttgaacacacatgctaccaagctctgggaaaaccccatagctttaagaagtacctgcaagggtcaggcgcagtggctcacacctgtaatcccagcactttgggaggccgaggtgggtggatggatcacctgacgtagagagtccaaggcctgacaaacatggagaaatgtcatccctatttaaaaaaataaaaaaattagccaagtgtggtggcgcatgcctgtaatcccagctactcgggaggctgaggcaggagaatcacttgaacctgggaggtggaggttgcagtgagccgagatctcgctattgcactccagcctgggcaacaagagtgaaactctgcctcaaaaaaaaataaaataaaataaaaataaaaataaggaagtacctgcaagaaagctactcaaagtaggtcaccagccaggagctctgacccaggctgcccagcctatccttgtgttgtctttttaattttcccttagatggtctgccctttccgtgatttctgtgtagaactctgtatcttgagctgtggtactatttttcttttgtcttttaatttaaatcttgttgggagctcttgtgatgaatattaaatacatacattttgggctgggtgtggtgcctctagcctataatcccagcactttgggaggccgaggcaggcgaatcgtgaggtcaggagatcgagaccatcctgcctaacacggtgaaacctcgtctctactaaaaatacaaaaaaattagccgggcgtggtggcgggtgcctatagtcccagctgctcgggaggctgaggcaggagaatggcatgaacccgggaggtggagcttgcagtgagctgagattgcaccactgcactccaggctgggcacagagcaagactccatctcaaaaaaaaaaaaaaaaaaaagacaaaaagaaaacattttggtcattaaaaaacaaaaaaaaaatgatacgagagagcacccagggattataagaggaaacactttattacatcactcatctaacattccagaaaatggaaagtactctactgtacagcaaagtaaatcattggttgtctggagaacagaaagaaagcctttataaaaaggttccaagtaaatataaaggtgttaagttcattattgtgactatgttaatggtttcatgggattatatgaaactcaagatttatcacatgctacagcttaaatatgcatagcttactgaatgtcatttataactcatcacagctttaaaatatacttcagactggcagcagtggctcacacctgtattcccaccactctgggaggctgaggcaggcatatcacctgaggtcaggagtccaagatcagcctggccaacatggcaaaactccgtctctactaaaaatacaaaacttggccgggcatggtggcacatgcttccagtcccacctacatgggaggctgagcc

SEQ ID NO: 369505 - DNA, 5061 bp, Homo sapiens
acgtatggtgcagtacattgattgaagtaacatgagagagaaggggtgggtgtagcaaaaacattctcaaggccaagtcatcagcccttacccttaggagggggcagtgattaagaggtggtatgagagcctcgtttctcatttctataagtgctggtaaaggacctgaccccacttccttacctactgcctgcccaggtaactgatgcctacagcatcacaggaattgccaaaatgcagaaaacaaatcctaaattgctctaattccataacacaaaggctggtttttggcttgaaataatcaggcacatatatcatgttctgtcacccagggtggagtgcagtggtgtgatctcggctcactacaaaccccgcctcctgggttcacgccattctccggcctcagcctcccgagtagctgggactacaggtgcccaccaccatgcccggctaattttttgtatttttagtagagacagggtttcaccatgttaaccagcatagtctctatcccctgactgcaagatctgcccgaatcagtgtcccaaagtgctgggattacaggcgtgagccaccgcacccagcccagaagggagtggacctttttatgtcaggacctcagcatggatacctatttgtccacctacttcttgttgctgatggcatttgaccagcaggcccatgaagagacaaaggcaccagtggatgtggtttcaactccgtgttggggaccttgggaggaggatgggcaagggtgggcgtgtgggagaggtgggttgtggtacctcagcagaggggctgcttgtggcttcatctgtcactatcatagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtacacaccaccacgcccagctaatttttgtgtttttagtggagatggggttttaccatgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttggagatcagcctgggcaacatggccagacctcctctctacaaaaagaaaaaagaatgacatgcttcttgtttttgtctgttataaatgaaactgctatatttgaatgcagttgttcatgtaggtatgtttcactatggtaatatggtggtgtgcagtgcctgagtcacgtgatagattaaagtacaactcttttttgagacagagtctcactctgtcacccaggcgggagttaggtggtgagccgagatcacggcactgcactccagcctgggtgacaagagcaagactccgtctcaaaataaataaataaaaataaaaaataaacatgatgatcacagatgcagtcacattttctgagttcttgtctctctgccagtgccacccagatagcctcacaaaactttgacccagccactgttagtgtcgccaccgcccataaaggagctgagcccagcaggggcactgcctggggccctgtagccaaaaggctacagcaggagctgatgaccctcatgatgcctggtgacaaaagaatttctgcctaccctgaaagccttatcaaatggacaccatccatgaagcagctggcacagtgtatgaagatctgaggtataagctcttgctggagttcctcaatgactacccacctttacgatgcacccacagtgaagttcctcacaccctgctaccaccctaacgtggacacccagggtaacatatgcctggacatcctgaaggagaagtggtctgccccgtatgatatcaggaccatcctgctctctatccagtgcctgctaggacaactcaacattgatagccctttgaacacacatgctaccaagctctgggaaaaccccatagctttaagaagtacctgcaagggtcaggcgcagtggctcacacctgtaatcccagcactttgggaggccgaggtgggtggatggatcacctgacgtagagagtccaaggcctgacaaacatggagaaatgtcatccctatttaaaaaaataaaaaaattagccaagtgtggtggcgcatgcctgtaatcccagctactcgggaggctgaggcaggagaatcacttgaacctgggaggtggaggttgcagtgagccgagatctcgctattgcactccagcctgggcaacaagagtgaaactctgcctcaaaaaaaaataaaataaaataaaaataaaaataaggaagtacctgcaagaaagctactcaaagtaggtcaccagccaggagctctgacccaggctgcccagcctatccttgtgttgtctttttaattttcccttagatggtctgccctttccgtgatttctgtgtagaactctgtatcttgagctgtggtactatttttcttttgtcttttaatttaaatcttgttgggagctcttgtgatgaatattaaatacatacattttgggctgggtgtggtgcctctagcctataatcccagcactttgggaggccgaggcaggcgaatcgtgaggtcaggagatcgagaccatcctgcctaacacggtgaaacctcgtctctactaaaaatacaaaaaaattagccgggcgtggtggcgggtgcctatagtcccagctgctcgggaggctgaggcaggagaatggcatgaacccgggaggtggagcttgcagtgagctgagattgcaccactgcactccaggctgggcacagagcaagactccatctcaaaaaaaaaaaaaaaaaaaagacaaaaagaaaacattttggtcattaaaaaacaaaaaaaaaatgatacgagagagcacccagggattataagaggaaacactttattacatcactcatctaacattccagaaaatggaaagtactctactgtacagcaaagtaaatcattggttgtctggagaacagaaagaaagcctttataaaaaggttccaagtaaatataaaggtgttaagttcattattgtgactatgttaatggtttcatgggattatatgaaactcaagatttatcacatgctacagcttaaatatgcatagcttactgaatgtcatttataactcatcacagctttaaaatatacttcagactggcagcagtggctcacacctgtattcccaccactctgggaggctgaggcaggcatatcacctgaggtcaggagtccaagatcagcctggccaacatggcaaaactccgtctctactaaaaatacaaaacttggccgggcatggtggcacatgcttccagtcccacctacatgggaggctgagcc

SEQ ID NO: 369506 - DNA, 3171 bp, Homo sapiens
  misc_feature (4)..(4): n is a, c, g, or t
tacnactactaaattcgcggccgcgtcgaaatagcaaggtacagtcagatgttaacagtctcagcccctaaatgtcaccttgtattacagcatgttatataagcacatacaggcacatacatgaaatagtgatacttcattctcagtaatatcttcatccttctcactggaaagatctttgatgatttttaatcaacataggagtttcaatgatatctagaagtttaaaagggctcgttcaaacaaattatgaccacacacactgaagagtatgtttgtctcttgtggtgtaaatttttttttattacaccaaattatgttcacacaaaacctttgtaatcagggggaattaaagagccttcctggaaaatggaggttgcaatcagccgagatggtgccatcgcactctagcctggggaatagagtgagatcctgcctcaaaaaaaacaaaaaaattctttattttctccataaactacagtttatataagcaaaagtttcagtactaagcaattttagtctctgcagtctcttgtcttgaattaatacaacttttgttaattctcttatgaagttaatcttcctgcttgtatgtgaattaaatatatgtcaaactttttttgtacaaaagattcatacctctttcctgtttgaaattattttactgtgtttcatcaatctaatgtttatttttattacaccagtaatttcctcattgtgttgaatcttacagtggcttataaatctacatgtacctagaaatgtttagccagtccatgtatatttgatgtggcacattttttcctttgaatcacatactctaagagaagtaacttcctcttgctaacctctactttccctaagtgttgaattaatcctctttagatgattataattctcttttcaatagctagaaagaatctataaggaactttcctggctgggtgtggtggctcatgcctgtaatcccagcacttcaggaggccgaggtgggtggatcacgaggtcaggagttccagaccagcctgaccaacatggttaaaccatgtctttactaaaaatgcaaaaattagcacctgtaatcccagctactcaggaggctgaggcatagaattgcttgaacctggcaggcagaggtggtgagccgagatcacggcactgcactccagcctgggtgacaagagcaagactccgtctcaaaataaataaataaaaataaaaaataaacatgatgatcacagatgcagtcacattttctgagttcttgtctctctgccagtgccacccagatagcctcacaaaactttgacccagccactgttagtgtcgccaccgcccataaaggagctgagcccagcaggggcactgcctggggccctgtagccaaaaggctacagcaggagctgatgaccctcatgatgcctggtgacaaaagaatttctgcctaccctgaaagccttatcaaatggacaccatccatgaagcagctggcacagtgtatgaagatctgaggtataagctcttgctggagttcctcaatgactacccacctttacgatgcacccacagtgaagttcctcacaccctgctaccaccctaacgtggacacccagggtaacatatgcctggacatcctgaaggagaagtggtctgccccgtatgatatcaggaccatcctgctctctatccagtgcctgctaggacaactcaacattgatagccctttgaacacacatgctaccaagctctgggaaaaccccatagctttaagaagtacctgcaagggtcaggcgcagtggctcacacctgtaatcccagcactttgggaggccgaggtgggtggatggatcacctgacgtagagagtccaaggcctgacaaacatggagaaatgtcatccctatttaaaaaaataaaaaaattagccaagtgtggtggcgcatgcctgtaatcccagctactcgggaggctgaggcaggagaatcacttgaacctgggaggtggaggttgcagtgagccgagatctcgctattgcactccagcctgggcaacaagagtgaaactctgcctcaaaaaaaaataaaataaaataaaaataaaaataaggaagtacctgcaagaaagctactcaaagtaggtcaccagccaggagctctgacccaggctgcccagcctatccttgtgttgtctttttaattttcccttagatggtctgccctttccgtgatttctgtgtagaactctgtatcttgagctgtggtactatttttcttttgtcttttaatttaaatcttgttgggagctcttgtgatgaatattaaatacatacattttgggctgggtgtggtgcctctagcctataatcccagcactttgggaggccgaggcaggcgaatcgtgaggtcaggagatcgagaccatcctgcctaacacggtgaaacctcgtctctactaaaaatacaaaaaaattagccgggcgtggtggcgggtgcctatagtcccagctgctcgggaggctgaggcaggagaatggcatgaacccgggaggtggagcttgcagtgagctgagattgcaccactgcactccaggctgggcacagagcaagactccatctcaaaaaaaaaaaaaaaaaaaagacaaaaagaaaacattttggtcattaaaaaacaaaaaaaaaatgatacgagagagcacccagggattataagaggaaacactttattacatcactcatctaacattccagaaaatggaaagtactctactgtacagcaaagtaaatcattggttgtctggagaacagaaagaaagcctttataaaaaggttccaagtaaatataaaggtgttaagttcattattgtgactatgttaatggtttcatgggattatatgaaactcaagatttatcacatgctacagcttaaatatgcatagcttactgaatgtcatttataactcatcacagctttaaaatatacttcagactggcagcagtggctcacacctgtattcccaccactctgggaggctgaggcaggcatatcacctgaggtcaggagtccaagatcagcctggccaacatggcaaaactccgtctctactaaaaatacaaaacttggccgggcatggtggcacatgcttccagtcccacctacatgggaggctgagcc

SEQ ID NO: 369507 - DNA, 3819 bp, Homo sapiens
acgtatggtgcagtacattgattgaagtaacatgagagagaaggggtgggtgtagcaaaaacattctcaaggccaagtcatcagcccttacccttaggagggggcagtgattaagaggtggtatgagagcctcgtttctcatttctataagtgctggtaaaggacctgaccccacttccttacctactgcctgcccaggtaactgatgcctacagcatcacaggaattgccaaaatgcagaaaacaaatcctaaattgctctaattccataacacaaaggctggtttttggcttgaaataatcaggcacatatatcatgttctgtcacccagggtggagtgcagtggtgtgatctcggctcactacaaaccccgcctcctgggttcacgccattctccggcctcagcctcccgagtagctgggactacaggtgcccaccaccatgcccggctaattttttgtatttttagtagagacagggtttcaccatgttaaccagcatagtctctatcccctgactgcaagatctgcccgaatcagtgtcccaaagtgctgggattacaggcgtgagccaccgcacccagcccagaagggagtggacctttttatgtcaggacctcagcatggatacctatttgtccacctacttcttgttgctgatggcatttgaccagcaggcccatgaagagacaaaggcaccagtggatgtggtttcaactccgtgttggggaccttgggaggaggatgggcaagggtgggcgtgtgggagaggtgggttgtggtacctcagcagaggggctgcttgtggcttcatctgtcactatcatagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtacacaccaccacgcccagctaatttttgtgtttttagtggagatggggttttaccatgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttggagatcagcctgggcaacatggccagacctcctctctacaaaaagaaaaaagaatgacatgcttcttgtttttgtctgttataaatgaaactgctatatttgaatgcagttgttcatgtaggtatgtttcactatggtaatatggtggtgtgcagtgcctgagtcacgtgatagattaaagtacaactcttttttgagacagagtctcactctgtcacccaggcgggagttaggtggtgagccgagatcacggcactgcactccagcctgggtgacaagagcaagactccgtctcaaaataaataaataaaaataaaaaataaacatgatgatcacagatgcagtcacattttctgagttcttgtctctctgccagtgccacccagatagcctcacaaaactttgacccagccactgttagtgtcgccaccgcccataaaggagctgagcccagcaggggcactgcctggggccctgtagccaaaaggctacagcaggagctgatgaccctcatgatgcctggtgacaaaagaatttctgcctaccctgaaagccttatcaaatggacaccatccatgaagcagctggcacagtgtatgaagatctgaggtataagctcttgctggagttcctcaatgactacccacctttacgatgcacccacagtgaagttcctcacaccctgctaccaccctaacgtggacacccagggtaacatatgcctggacatcctgaaggagaagtggtctgccccgtatgatatcaggaccatcctgctctctatccagtgcctgctaggacaactcaacattgatagccctttgaacacacatgctaccaagctctgggaaaaccccatagctttaagaagtacctgcaagggtcaggcgcagtggctcacacctgtaatcccagcactttgggaggccgaggtgggtggatggatcacctgacgtagagagtccaaggcctgacaaacatggagaaatgtcatccctatttaaaaaaataaaaaaattagccaag

SEQ ID NO: 369508 - DNA, 5135 bp, Homo sapiens
  misc_feature (4024)..(4024): n is a, c, g, or t
acgtatggtgcagtacattgattgaagtaacatgagagagaaggggtgggtgtagcaaaaacattctcaaggccaagtcatcagcccttacccttaggagggggcagtgattaagaggtggtatgagagcctcgtttctcatttctataagtgctggtaaaggacctgaccccacttccttacctactgcctgcccaggtaactgatgcctacagcatcacaggaattgccaaaatgcagaaaacaaatcctaaattgctctaattccataacacaaaggctggtttttggcttgaaataatcaggcacatatatcatgttctgtcacccagggtggagtgcagtggtgtgatctcggctcactacaaaccccgcctcctgggttcacgccattctccggcctcagcctcccgagtagctgggactacaggtgcccaccaccatgcccggctaattttttgtatttttagtagagacagggtttcaccatgttaaccagcatagtctctatcccctgactgcaagatctgcccgaatcagtgtcccaaagtgctgggattacaggcgtgagccaccgcacccagcccagaagggagtggacctttttatgtcaggacctcagcatggatacctatttgtccacctacttcttgttgctgatggcatttgaccagcaggcccatgaagagacaaaggcaccagtggatgtggtttcaactccgtgttggggaccttgggaggaggatgggcaagggtgggcgtgtgggagaggtgggttgtggtacctcagcagaggggctgcttgtggcttcatctgtcactatcatagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtacacaccaccacgcccagctaatttttgtgtttttagtggagatggggttttaccatgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttggagatcagcctgggcaacatggccagacctcctctctacaaaaagaaaaaagaatgacatgcttcttgtttttgtctgttataaatgaaactgctatatttgaatgcagttgttcatgtaggtatgtttcactatggtaatatggtggtgtgcagtgcctgagtcacgtgatagattaaagtacaactcttttttgagacagagtctcactctgtcacccaggcgggagttaggtggcatgatttcggctcactgcaacctctgcctcccaagttcaactgattcttctgcctcagcctcccgagtagcagggattaccggtgtgcaccaccatgcctggataacttttttttttatttctattagcaatggggtttcaccatgctggccaggcttgttatgaactgacctcaagtgatctgcctgcctcagcttctcaggtgtgacctactgtgcttggcctaatgtacaactttttaagcaatgccaaactatgacttaagaatgaaattattgctcatttgtatatctatctaccatcagtgtccaagaatttctgttctatcttaccaagagggagtatggttagtatttgaaattgtttattattttaataagtggttataacttttgagtcagtggtttatgttttgcattttttttgttttgagacaaagtctcgctctgtctcccaggctagagtaccgtggcacaatctcagctcattgcaacctctgcttcctgggctcaagcactctgcccacctcagcctccagagtagctggaaatacaggtatgcaccaccacaactggataacttttgtattttctgtagagagggttttacctttttgcccagtctgatcgcgaactcctgggctcaggcgatccacttgcctaggctccaaaagtgcttggtctacaggggtgaggcaccctgcctggcctcacctgtaggcttgttttttaaaatgaattttatctatttcccatttcattaatatatttaaaaataatgaaataacaaagacgtatgttggacttcattcattcttcagtgatgtcactttgctgcaaggaatatttggttttcttttttttttttttttccagatggagtctagctctgtctcctaagctacagtgaagtggcatgatctcggcccactgcaacctccacctcctgtgttcaagcgattctgcctcagcctcctgagtagctgggactacnggcatgtgccattatacctggctaattttatttatttattttagtagagatggggtttcaccatgttacccaggctgctctctaccttctgagctcaagtgatccacctgcctcggcctcccaaagtgctgggattacaggtgtcagccactgtacctggctgaatacttggttttcagtaccacaagaactatgagctggttatccacttcatgtggaatcataagcgtcccaaagtgacaatacatatagattgccaggcagtgaaacagttaagatgccaccatagctttcttttcaacatctttctaagattaccttactatttcttttgttccaagtttgtacttcctcacagttctcacatatggaaaggatacacactttgtagaaacaagaactttatgttatccaagttctaggatagccatgagctccaattatctcagagctctgagtcctctactcaatacccattgagatttatgtgttctgaggcttttgtcttctagctacttacttcattctccatgggtaacgtcattcatccacattaactaatttcctcactccaagctcttttctagagataatctccagtccctgtgcagaaactgtcattgcactttctgctgaaatggcagtttcttctcagcaaggtgagattatggaatccagaatcttttttcaggggtcacatgcccatttccccacttgcatgaatgtcgacactgcagccacagttttggccgtaaatgtgaatttggcaagtaaccactgttcccagggaaatgtcccaatcagaagaagattatctgggacactgatactgacagggagatgggacattctgagggacccggaggcagggtgccacctcctcaacttccctgagggctgcctagaatctgtttcctctcactctgaattattcttcctcttatggctgaccaaaaacatggaacctcacaaagtccactgtaacagctttatatttgtgaagtgaagaacatgaagacagtttcaagcaaagttattgagtggacactttgtgttttttttgagaagtctcacttccaacctggtgacagagagacacatcatctcaaaa

SEQ ID NO: 369509 - DNA, 3655 bp, Homo sapiens
gattctcctgcctcagcctcctgagtagctgggattacaggcatgtaccaccacactcggctaatttttctatttttagtaaagtcggggtttcaccatgttggccaggctagtctcaaactcctgacctcaggagattcgctggcctctgcctccccaagtgctgggattataggcacgagccaccatgccttgcagacagctagattttctaatgtggatgataggagcatgaaagaggaatcgggcatgagcccaaggtttttgatcttagcagctgtaaccatgcacactgcttcagctgagatgacgttggtattgacataatattcactgtggatatccagagggttgttttggccatatgaagaatcagagaccaataagtggtggcatcaaatcgataactagacatactggatggggtatctgggagggtgttgatactggagacatccaatatatgaaagctaatgagtgaactatgattagttatgggtccatttaggaggacatgcttcagattatggtggtaaatcttttcagggggcagaaaggtgtgattacaggctgaggactggatctcttacttacgtcctcaattgatgttattgggcttcctaaacacctgagagggtgtgagtgaccatcataacaggacatttaatacagtagagtttggaaggggacatagacatccaaagagataatagagaagagatagatgcatgcagaagcacaggagtaattcagggaagatgacacttaggcctgagttggtgccaaagttgtaacttttttgttttttttttttcagatggagtttcgctcttgttgcccaagctggagtgcaatggtgccatctcggctcactgcaacctccacctcctgggttcaagcaattctcctgcctcagcctcccaagtagctagtattacaggcacctgccaccacagcaggctaatttttgtattttcggtagagacagggtttcaccatgctgaccaggctagtcttgaactcctgaccgggtgatctgcctgcctcggcctcaaagtgctggaattgcaggcgtgagccactgtgcctggccagttgtaactatttatcactgtctggactcataaacattttgagatgactttgggagtgcctggggagtttcattcagcctggtgcatatgggcagtgaaaaatatgctcatctgtgatagtagatgtggtttggttcacaaatccaggggctgggctttaaacggcattaggtggacagaggagggttgctacagctgaggtctcagctggtgcagcacaaaagtgaaatagggccatggctatctgaagccatatgtggttctgtgtggctatggagtcattccaggagacgttcacaggatgatttgggattaccactgctattgtaaaccatggaaattctgtgttaatattggatgctatttgtatttgtcaagcatagtctggatgcttatccacattttggtataaggccagaattgaaggcccaatatgatgtgtcactttgacatcttgtgaaagtgggacaaccttaaaaggtgtgagtacaaatctcattcccactctgctctcttgaataatgtatcctagcctaacagcccgttttatcaaggtgataaggcagggttccaggttgttatattttgtggtgggtttcaattccatccctaccagcagagttatggaaacaaaccattgcatattcccaagggaatcatgggccgttataccctcttcatcttgtgaaataattttatttgtaggcgctgggtgtggtggctcacccctataatctcctcactttcagaggccaaggctggtggatcacttgagaccagaaattcaagaccagcctggccaacatggtgaaaccccgtctctacttaaagatacaaaaaattagctgggtatggtggcgggcacctgtagtcccagctacttgggaggctgaggcagaagaatggtgtgaacccaggaggcagagcttgcagtgagccgagatcgtgccactgcactccatccagcctgggcaacagagcaagactccgtctcaaaataaataataataataattaaaaaaatgcagttcaaaagaaaaatatagatttaccattatttttggaaaacaggtttggcaactctatactgactacaccaattcttctcatgccctaagtgggaaaactagcctccacggtagcaaatattgatgtggcactaaggccatttccacctgattaagtggctggctggtcacaaaggccacatcactgaactgagatctcccttctccctatcatcttcctcctgttaatgcaggaatgaccttgaggagaacagcccagaatgagtacaggaattcacaaaacctttagattatttcctctgacaatggcctcaacaatacaatattcatcattatggaagtcctgataattcctgtatctgcatattcatcatatacgtagtgactggatcattgtggatgcccttttaaaagacatgcattacgctgcacgtggtggctcacctgtaatcccaggactttgggaggctgaggccagcagatcacaaggtcaggagttcgagaccagcctggccaacatggtgaaaccccatctctactaaaaatacaaaaattagctgggtgtggtggcatgtgcctgtagtcccagctactcaggaggctgaggcaggagaatcgtttgaacctgggaggcagaggttgccgtgagccaagattatgccactgcactccagcctgggcaacagggtgaggctctgcctcaaaaaaaaagaaaaaaaaagaaaaaaaagacatgagttgcagttacattattctgtctcctccactgcctataaataaagtaattctataaaattataatttcacctgatagcattacaatctgtgatgttatcctacagaattctggatatcagggcatgtgtctgcattgcaagagctgggcaacagacttccctcagccgtaccaagtacaatgcaatatacctcgtaaaagaattttgtcttgttcaaaaaatgccagaaattgtcacaaaaaatgccctgtatccagctgacctatgaacccacaaattttagtatccgtgctacagataaagaccacaaagccctgaaggtcttctctggaggcctctggcagctatgcaaagcagtccacaagtggagaaagctacattctgcattcatactgttccatgagccacaaagtttagctatgccaacaaaagctgtgacccccttcatagtaacaggacctacttatttctgaaccacccatacagtgacaacaaccctcaagattgaagaaggctgaaacaataaggccttcataatagcacaaaccggagaaatgggaggcaagctgttcttaggatcatgacttggagggtagaaaatttgtcaagattgatgtgatacccacaagatctctgaaagacatagtccgtcttttcaagtcaacgtaagaggcctctgggataaaaatgggtaacgtccatggcatgacttatcagacagaaaaaaatgacaaaggaagaagtgctgaagctactcaacaaatccttctgtgactcgatcagaaattaaaagtta

SEQ ID NO: 369510 - DNA, 2563 bp, Homo sapiens
gtatttttagtagagacggggtttcaccatcttggccaggctggtcttgaactcctgacctcatgatccacccaatgtttatttttattacaccagtaatttcctcattgtgttgaatcttacagtggcttataaatctacatgtacctagaaatgtttagccagtccatgtatatttgatgtggcacattttttcctttgaatcacatactctaagagaagtaacttcctcttgctaacctctactttccctaagtgttgaattaatcctctttagatgattataattctcttttcaatagctagaaagaatctataaggaactttcctggctgggtgtggtggctcatgcctgtaatcccagcacttcaggaggccgaggtgggtggatcacgaggtcaggagttccagaccagcctgaccaacatggttaaaccatgtctttactaaaaatgcaaaaattagcacctgtaatcccagctactcaggaggctgaggcatagaattgcttgaacctggcaggcagaggtggtgagccgagatcacggcactgcactccagcctgggtgacaagagcaagactccgtctcaaaataaataaataaaaataaaaaataaacatgatgatcacagatgcagtcacattttctgagttcttgtctctctgccagtgccacccagatagcctcacaaaactttgacccagccactgttagtgtcgccaccgcccataaaggagctgagcccagcaggggcactgcctggggccctgtagccaaaaggctacagcaggagctgatgaccctcatgatgcctggtgacaaaagaatttctgcctaccctgaaagccttatcaaatggacaccatccatgaagcagctggcacagtgtatgaagatctgaggtataagctcttgctggagttcctcaatgactacccacctttacgatgcacccacagtgaagttcctcacaccctgctaccaccctaacgtggacacccagggtaacatatgcctggacatcctgaaggagaagtggtctgccccgtatgatatcaggaccatcctgctctctatccagtgcctgctaggacaactcaacattgatagccctttgaacacacatgctaccaagctctgggaaaaccccatagctttaagaagtacctgcaagggtcaggcgcagtggctcacacctgtaatcccagcactttgggaggccgaggtgggtggatggatcacctgacgtagagagtccaaggcctgacaaacatggagaaatgtcatccctatttaaaaaaataaaaaaattagccaagtgtggtggcgcatgcctgtaatcccagctactcgggaggctgaggcaggagaatcacttgaacctgggaggtggaggttgcagtgagccgagatctcgctattgcactccagcctgggcaacaagagtgaaactctgcctcaaaaaaaaataaaataaaataaaaataaaaataaggaagtacctgcaagaaagctactcaaagtaggtcaccagccaggagctctgacccaggctgcccagcctatccttgtgttgtctttttaattttcccttagatggtctgccctttccgtgatttctgtgtagaactctgtatcttgagctgtggtactatttttcttttgtcttttaatttaaatcttgttgggagctcttgtgatgaatattaaatacatacattttgggctgggtgtggtgcctctagcctataatcccagcactttgggaggccgaggcaggcgaatcgtgaggtcaggagatcgagaccatcctgcctaacacggtgaaacctcgtctctactaaaaatacaaaaaaattagccgggcgtggtggcgggtgcctatagtcccagctgctcgggaggctgaggcaggagaatggcatgaacccgggaggtggagcttgcagtgagctgagattgcaccactgcactccaggctgggcacagagcaagactccatctcaaaaaaaaaaaaaaaaaaaagacaaaaagaaaacattttggtcattaaaaaacaaaaaaaaaatgatacgagagagcacccagggattataagaggaaacactttattacatcactcatctaacattccagaaaatggaaagtactctactgtacagcaaagtaaatcattggttgtctggagaacagaaagaaagcctttataaaaaggttccaagtaaatataaaggtgttaagttcattattgtgactatgttaatggtttcatgggattatatgaaactcaagatttatcacatgctacagcttaaatatgcatagcttactgaatgtcatttataactcatcacagctttaaaatatacttcagactggcagcagtggctcacacctgtattcccaccactctgggaggctgaggcaggcatatcacctgaggtcaggagtccaagatcagcctggccaacatggcaaaactccgtctctactaaaaatacaaaacttggccgggcatggtggcacatgcttccagtcccacctacatgggaggctgagcc

SEQ ID NO: 369511 - DNA, 2952 bp, Homo sapiens
agtgcttcccccaagtaagtcccgatggacctggctcccccgagacgcccctactcaggagcaacttggcgaggttcagactcttggagccagaagctacatgacccctaaacgatggagtttcgctcttgttgcccaagctggagtgcaatggtgccatctcggctcactgcaacctccacctcctgggttcaagcaattctcctgcctcagcctcccaagtagctagtattacaggcacctgccaccacagcaggctaatttttgtattttcggtagagacagggtttcaccatgctgaccaggctagtcttgaactcctgaccgggtgatctgcctgcctcggcctcaaagtgctggaattgcaggcgtgagccactgtgcctggccagttgtaactatttatcactgtctggactcataaacattttgagatgactttgggagtgcctggggagtttcattcagcctggtgcatatgggcagtgaaaaatatgctcatctgtgatagtagatgtggtttggttcacaaatccaggggctgggctttaaacggcattaggtggacagaggagggttgctacagctgaggtctcagctggtgcagcacaaaagtgaaatagggccatggctatctgaagccatatgtggttctgtgtggctatggagtcattccaggagacgttcacaggatgatttgggattaccactgctattgtaaaccatggaaattctgtgttaatattggatgctatttgtatttgtcaagcatagtctggatgcttatccacattttggtataaggccagaattgaaggcccaatatgatgtgtcactttgacatcttgtgaaagtgggacaaccttaaaaggtgtgagtacaaatctcattcccactctgctctcttgaataatgtatcctagcctaacagcccgttttatcaaggtgataaggcagggttccaggttgttatattttgtggtgggtttcaattccatccctaccagcagagttatggaaacaaaccattgcatattcccaagggaatcatgggccgttataccctcttcatcttgtgaaataattttatttgtaggcgctgggtgtggtggctcacccctataatctcctcactttcagaggccaaggctggtggatcacttgagaccagaaattcaagaccagcctggccaacatggtgaaaccccgtctctacttaaagatacaaaaaattagctgggtatggtggcgggcacctgtagtcccagctacttgggaggctgaggcagaagaatggtgtgaacccaggaggcagagcttgcagtgagccgagatcgtgccactgcactccatccagcctgggcaacagagcaagactccgtctcaaaataaataataataataattaaaaaaatgcagttcaaaagaaaaatatagatttaccattatttttggaaaacaggtttggcaactctatactgactacaccaattcttctcatgccctaagtgggaaaactagcctccacggtagcaaatattgatgtggcactaaggccatttccacctgattaagtggctggctggtcacaaaggccacatcactgaactgagatctcccttctccctatcatcttcctcctgttaatgcaggaatgaccttgaggagaacagcccagaatgagtacaggaattcacaaaacctttagattatttcctctgacaatggcctcaacaatacaatattcatcattatggaagtcctgataattcctgtatctgcatattcatcatatacgtagtgactggatcattgtggatgcccttttaaaagacatgcattacgctgcacgtggtggctcacctgtaatcccaggactttgggaggctgaggccagcagatcacaaggtcaggagttcgagaccagcctggccaacatggtgaaaccccatctctactaaaaatacaaaaattagctgggtgtggtggcatgtgcctgtagtcccagctactcaggaggctgaggcaggagaatcgtttgaacctgggaggcagaggttgccgtgagccaagattatgccactgcactccagcctgggcaacagggtgaggctctgcctcaaaaaaaaagaaaaaaaaagaaaaaaaagacatgagttgcagttacattattctgtctcctccactgcctataaataaagtaattctataaaattataatttcacctgatagcattacaatctgtgatgttatcctacagaattctggatatcagggcatgtgtctgcattgcaagagctgggcaacagacttccctcagccgtaccaagtacaatgcaatatacctcgtaaaagaattttgtcttgttcaaaaaatgccagaaattgtcacaaaaaatgccctgtatccagctgacctatgaacccacaaattttagtatccgtgctacagataaagaccacaaagccctgaaggtcttctctggaggcctctggcagctatgcaaagcagtccacaagtggagaaagctacattctgcattcatactgttccatgagccacaaagtttagctatgccaacaaaagctgtgacccccttcatagtaacaggacctacttatttctgaaccacccatacagtgacaacaaccctcaagattgaagaaggctgaaacaataaggccttcataatagcacaaaccggagaaatgggaggcaagctgttcttaggatcatgacttggagggtagaaaatttgtcaagattgatgtgatacccacaagatctctgaaagacatagtccgtcttttcaagtcaacgtaagaggcctctgggataaaaatgggtaacgtccatggcatgacttatcagacagaaaaaaatgacaaaggaagaagtgctgaagctactcaacaaatccttctgtgactcgatcagaaattaaaagtta

SEQ ID NO: 369512 - DNA, 2656 bp, Homo sapiens
ggtaccctagtgtaggccggacgcagtggctatgttaatggtttcatgggattatgtgaaactcaagatttatcacatgctacagcttaaatatgcatagcttactgaatgtcatttataactcataaacattttgagatgactttgggagtgcctggggagtttcattcagcctggtgcatatgggcagtgaaaaatatgctcatctgtgatagtagatgtggtttggttcacaaatccaggggctgggctttaaacggcattaggtggacagaggagggttgctacagctgaggtctcagctggtgcagcacaaaagtgaaatagggccatggctatctgaagccatatgtggttctgtgtggctatggagtcattccaggagacgttcacaggatgatttgggattaccactgctattgtaaaccatggaaattctgtgttaatattggatgctatttgtatttgtcaagcatagtctggatgcttatccacattttggtataaggccagaattgaaggcccaatatgatgtgtcactttgacatcttgtgaaagtgggacaaccttaaaaggtgtgagtacaaatctcattcccactctgctctcttgaataatgtatcctagcctaacagcccgttttatcaaggtgataaggcagggttccaggttgttatattttgtggtgggtttcaattccatccctaccagcagagttatggaaacaaaccattgcatattcccaagggaatcatgggccgttataccctcttcatcttgtgaaataattttatttgtaggcgctgggtgtggtggctcacccctataatctcctcactttcagaggccaaggctggtggatcacttgagaccagaaattcaagaccagcctggccaacatggtgaaaccccgtctctacttaaagatacaaaaaattagctgggtatggtggcgggcacctgtagtcccagctacttgggaggctgaggcagaagaatggtgtgaacccaggaggcagagcttgcagtgagccgagatcgtgccactgcactccatccagcctgggcaacagagcaagactccgtctcaaaataaataataataataattaaaaaaatgcagttcaaaagaaaaatatagatttaccattatttttggaaaacaggtttggcaactctatactgactacaccaattcttctcatgccctaagtgggaaaactagcctccacggtagcaaatattgatgtggcactaaggccatttccacctgattaagtggctggctggtcacaaaggccacatcactgaactgagatctcccttctccctatcatcttcctcctgttaatgcaggaatgaccttgaggagaacagcccagaatgagtacaggaattcacaaaacctttagattatttcctctgacaatggcctcaacaatacaatattcatcattatggaagtcctgataattcctgtatctgcatattcatcatatacgtagtgactggatcattgtggatgcccttttaaaagacatgcattacgctgcacgtggtggctcacctgtaatcccaggactttgggaggctgaggccagcagatcacaaggtcaggagttcgagaccagcctggccaacatggtgaaaccccatctctactaaaaatacaaaaattagctgggtgtggtggcatgtgcctgtagtcccagctactcaggaggctgaggcaggagaatcgtttgaacctgggaggcagaggttgccgtgagccaagattatgccactgcactccagcctgggcaacagggtgaggctctgcctcaaaaaaaaagaaaaaaaaagaaaaaaaagacatgagttgcagttacattattctgtctcctccactgcctataaataaagtaattctataaaattataatttcacctgatagcattacaatctgtgatgttatcctacagaattctggatatcagggcatgtgtctgcattgcaagagctgggcaacagacttccctcagccgtaccaagtacaatgcaatatacctcgtaaaagaattttgtcttgttcaaaaaatgccagaaattgtcacaaaaaatgccctgtatccagctgacctatgaacccacaaattttagtatccgtgctacagataaagaccacaaagccctgaaggtcttctctggaggcctctggcagctatgcaaagcagtccacaagtggagaaagctacattctgcattcatactgttccatgagccacaaagtttagctatgccaacaaaagctgtgacccccttcatagtaacaggacctacttatttctgaaccacccatacagtgacaacaaccctcaagattgaagaaggctgaaacaataaggccttcataatagcacaaaccggagaaatgggaggcaagctgttcttaggatcatgacttggagggtagaaaatttgtcaagattgatgtgatacccacaagatctctgaaagacatagtccgtcttttcaagtcaacgtaagaggcctctgggataaaaatgggtaacgtccatggcatgacttatcagacagaaaaaaatgacaaaggaagaagtgctgaagctactcaacaaatccttctgtgactcgatcagaaattaaaagtta

SEQ ID NO: 369513 - DNA, 2052 bp, Homo sapiens
gattctcctgcctcagcctcctgagtagctgggattacaggcatgtaccaccacactcggctaatttttctatttttagtaaagtcggggtttcaccatgttggccaggctagtctcaaactcctgacctcaggagattcgctggcctctgcctccccaagtgctgggattataggcacgagccaccatgccttgcagacagctagattttctaatgtggatgataggagcatgaaagaggaatcgggcatgagcccaaggtttttgatcttagcagctgtaaccatgcacactgcttcagctgagatgacgttggtattgacataatattcactgtggatatccagagggttgttttggccatatgaagaatcagagaccaataagtggtggcatcaaatcgataactagacatactggatggggtatctgggagggtgttgatactggagacatccaatatatgaaagctaatgagtgaactatgattagttatgggtccatttaggaggacatgcttcagattatggtggtaaatcttttcagggggcagaaaggtgtgattacaggctgaggactggatctcttacttacgtcctcaattgatgttattgggcttcctaaacacctgagagggtgtgagtgaccatcataacaggacatttaatacagtagagtttggaaggggacatagacatccaaagagataatagagaagagatagatgcatgcagaagcacaggagtaattcagggaagatgacacttaggcctgagttggtgccaaagttgtaacttttttgttttttttttttcagatggagtttcgctcttgttgcccaagctggagtgcaatggtgccatctcggctcactgcaacctccacctcctgggttcaagcaattctcctgcctcagcctcccaagtagctagtattacaggcacctgccaccacagcaggctaatttttgtattttcggtagagacagggtttcaccatgctgaccaggctagtcttgaactcctgaccgggtgatctgcctgcctcggcctcaaagtgctggaattgcaggcgtgagccactgtgcctggccagttgtaactatttatcactgtctggactcataaacattttgagatgactttgggagtgcctggggagtttcattcagcctggtgcatatgggcagtgaaaaatatgctcatctgtgatagtagatgtggtttggttcacaaatccaggggctgggctttaaacggcattaggtggacagaggagggttgctacagctgaggtctcagctggtgcagcacaaaagtgaaatagggccatggctatctgaagccatatgtggttctgtgtggctatggagtcattccaggagacgttcacaggatgatttgggattaccactgctattgtaaaccatggaaattctgtgttaatattggatgctatttgtatttgtcaagcatagtctggatgcttatccacattttggtataaggccagaattgaaggcccaatatgatgtgtcactttgacatcttgtgaaagtgggacaaccttaaaaggtgtgagtacaaatctcattcccactctgctctcttgaataatgtatcctagcctaacagcccgttttatcaaggtgataaggcagggttccaggttgttatattttgtggtgggtttcaattccatccctaccagcagagttatggaaacaaaccattgcatattcccaagggaatcatgggccgttataccctcttcatcttgtgaaataattttatttgtaggcgctgggtgtggtggctcacccctataatctcctcactttcagaggccaaggctggtggatcacttgagaccagaaattcaagaccagcctggccaacatggtgaaaccccgtctctactaaaaaaaaaaaatacaggccaggcatggtggctcaagcctggaatcccagcactttgggatgctgaggtgggtggatcaggaagtatggagatcgagaccatcctggctaacacagtgaaaccccgtctcta

SEQ ID NO: 369514 - DNA, 1495 bp, Homo sapiens
gaatggatgaccaggcactagttgaaggcagcgtgtgtctcaaggatgaggatgacccactgttcctgttcctgaggtggtcaacttctggcacagtgtatgaagatctgaggtataagctcttgctggagttcctcaatgactacccacctttacgatgcacccacagtgaagttcctcacaccctgctaccaccctaacgtggacacccagggtaacatatgcctggacatcctgaaggagaagtggtctgccccgtatgatatcaggaccatcctgctctctatccagtgcctgctaggacaactcaacattgatagccctttgaacacacatgctaccaagctctgggaaaaccccatagctttaagaagtacctgcaagggtcaggcgcagtggctcacacctgtaatcccagcactttgggaggccgaggccagcagatcacaaggtcaggagttcgagaccagcctggccaacatggtgaaaccccatctctactaaaaatacaaaaattagctgggtgtggtggcatgtgcctgtagtcccagctactcaggaggctgaggcaggagaatcgtttgaacctgggaggcagaggttgccgtgagccaagattatgccactgcactccagcctgggcaacagggtgaggctctgcctcaaaaaaaaagaaaaaaaaagaaaaaaaagacatgagttgcagttacattattctgtctcctccactgcctataaataaagtaattctataaaattataatttcacctgatagcattacaatctgtgatgttatcctacagaattctggatatcagggcatgtgtctgcattgcaagagctgggcaacagacttccctcagccgtaccaagtacaatgcaatatacctcgtaaaagaattttgtcttgttcaaaaaatgccagaaattgtcacaaaaaatgccctgtatccagctgacctatgaacccacaaattttagtatccgtgctacagataaagaccacaaagccctgaaggtcttctctggaggcctctggcagctatgcaaagcagtccacaagtggagaaagctacattctgcattcatactgttccatgagccacaaagtttagctatgccaacaaaagctgtgacccccttcatagtaacaggacctacttatttctgaaccacccatacagtgacaacaaccctcaagattgaagaaggctgaaacaataaggccttcataatagcacaaaccggagaaatgggaggcaagctgttcttaggatcatgacttggagggtagaaaatttgtcaagattgatgtgatacccacaagatctctgaaagacatagtccgtcttttcaagtcaacgtaagaggcctctgggataaaaatgggtaacgtccatggcatgacttatcagacagaaaaaaatgacaaaggaagaagtgctgaagctactcaacaaatccttctgtgactcgatcagaaattaaaagtta

SEQ ID NO: 369515 - DNA, 951 bp, Homo sapiens
tttttttggtttggttttgtttgagatggagtctcactccagcctggcagcagagggagactccatctcaaacaaacaaacaaacaaaaaaagatactttaagttgtttaaaggccagagagaggccagtggtgtgtggcagtcagctggggatggacatggaatgtacctggaagtctaaagaatgaggtgcgttcagagagggtatctctgctgtgctgaaggtgccacattgggcttcccatgacctcggccatactagggaaagtgcctgtcaggagtgggtggactttatgtcacagccactgcacagatacctatttgttcaactaactattgttggtggctgtaccccatgaccagtgggcctagtttctcctatgtttgaggaccttgagaggaggatgtgcgagagtagatgtgtgggagagatggattgtgatacctcagcataggggtggtttgtggtttcatctgtcaacatcataacagggcacagtgacttttgaagacgtggctgtgaaatttacccaggaggaatggaatctccttagtgaggctcagagatgcctgtaccgtgatgtgactctggagaacctggcacttatgtcctccctgggtaagttgctcacactcaccctgtgacttgagctagtctctgttttcccctgtctttccccattggcaagactttctcatgtcaggagcatggacacagcttcctgcttcagttctatgggtaggttcttggttgtaggactgaggtgtacatactgccctactcctttcttggagcagccccagcacctgctttactgcaggctcccagggagggattcccagtcagaagcccaccttgttagtcctgtggatgtttgggtgtccttgtccagatttcaggttcctgtgtacccacagtctacttcctttctctagctgctattttcttat

SEQ ID NO: 369516 - DNA, 3642 bp, Homo sapiens
ggccgagacttccggggtctctagtagcggctgtgtatcggcgatgcgggtgtttccccagtttgtggcccctgagtgctgggtgggaccgcggtgactgaacctagaaggtggagaggaatcgtcctcggtgcccagaggcggctctgcagccccgtgacggcgaccactgctcccgggccgtgcttccccaagtagtccgatggcagcggctgtgccgaggcgcccaactcagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtacacaccaccacgcccagctaatttttgtgtttttagtggagatggggttttaccatgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttggagatcagcctgggcaacatggccagacctcctctctacaaaaagaaaaaagaatgacatgcttcttgtttttgtctgttataaatgaaactgctatatttgaatgcagttgttcatgtaggtatgtttcactatggtaatatggtggtgtgcagtgcctgagtcacgtgatagattaaagtacaactcttttttgagacagagtctcactctgtcacccaggcgggagttaggtggcatgatttcggctcactgcaacctctgcctcccaagttcaactgattcttctgcctcagcctcccgagtagcagggattaccggtgtgcaccaccatgcctggataacttttttttttatttctattagcaatggggtttcaccatgctggccaggcttgttatgaactgacctcaagtgatctgcctgcctcagcttctcaggtgtgacctactgtgcttggcctaatgtacaactttttaagcaatgccaaactatgacttaagaatgaaattattgctcatttgtatatctatctaccatcagtgtccaagaatttctgttctatcttaccaagagggagtatggttagtatttgaaattgtttattattttaataagtggttataacttttgagtcagtggtttatgttttgcattttttttgttttgagacaaagtctcgctctgtctcccaggctagagtaccgtggcacaatctcagctcattgcaacctctgcttcctgggctcaagcactctgcccacctcagcctccagagtagctggaaatacagtgccacccagatagcctcacaaaactttgacccagccactgttagtgtcgccaccgcccataaaggagctgagcccagcaggggcactgcctggggccctgtagccaaaaggctacagcaggagctgatgaccctcatgatgcctggtgacaaaagaatttctgcctaccctgaaagccttatcaaatggacaccatccatgaagcagctggcacagtgtatgaagatctgaggtataagctcttgctggagttcctcaatgactacccacctttacgatgcacccacagtgaagttcctcacaccctgctaccaccctaacgtggacacccagggtaacatatgcctggacatcctgaaggagaagtggtctgccccgtatgatatcaggaccatcctgctctctatccagtgcctgctaggacaactcaacattgatagccctttgaacacacatgctaccaagctctgggaaaaccccatagctttaagaagtacctgcaagggtcaggcgcagtggctcacacctgtaatcccagcactttgggaggccgaggtgggtggatggatcacctgacgtagagagtccaaggcctgacaaacatggagaaatgtcatccctatttaaaaaaataaaaaaattagccaag

SEQ ID NO: 369517 - DNA, 6173 bp, Homo sapiens
  misc_feature (4024)..(4024): n is a, c, g, or t
  misc_feature (5266)..(5266): n is a, c, g, or t
acgtatggtgcagtacattgattgaagtaacatgagagagaaggggtgggtgtagcaaaaacattctcaaggccaagtcatcagcccttacccttaggagggggcagtgattaagaggtggtatgagagcctcgtttctcatttctataagtgctggtaaaggacctgaccccacttccttacctactgcctgcccaggtaactgatgcctacagcatcacaggaattgccaaaatgcagaaaacaaatcctaaattgctctaattccataacacaaaggctggtttttggcttgaaataatcaggcacatatatcatgttctgtcacccagggtggagtgcagtggtgtgatctcggctcactacaaaccccgcctcctgggttcacgccattctccggcctcagcctcccgagtagctgggactacaggtgcccaccaccatgcccggctaattttttgtatttttagtagagacagggtttcaccatgttaaccagcatagtctctatcccctgactgcaagatctgcccgaatcagtgtcccaaagtgctgggattacaggcgtgagccaccgcacccagcccagaagggagtggacctttttatgtcaggacctcagcatggatacctatttgtccacctacttcttgttgctgatggcatttgaccagcaggcccatgaagagacaaaggcaccagtggatgtggtttcaactccgtgttggggaccttgggaggaggatgggcaagggtgggcgtgtgggagaggtgggttgtggtacctcagcagaggggctgcttgtggcttcatctgtcactatcatagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtacacaccaccacgcccagctaatttttgtgtttttagtggagatggggttttaccatgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttggagatcagcctgggcaacatggccagacctcctctctacaaaaagaaaaaagaatgacatgcttcttgtttttgtctgttataaatgaaactgctatatttgaatgcagttgttcatgtaggtatgtttcactatggtaatatggtggtgtgcagtgcctgagtcacgtgatagattaaagtacaactcttttttgagacagagtctcactctgtcacccaggcgggagttaggtggcatgatttcggctcactgcaacctctgcctcccaagttcaactgattcttctgcctcagcctcccgagtagcagggattaccggtgtgcaccaccatgcctggataacttttttttttatttctattagcaatggggtttcaccatgctggccaggcttgttatgaactgacctcaagtgatctgcctgcctcagcttctcaggtgtgacctactgtgcttggcctaatgtacaactttttaagcaatgccaaactatgacttaagaatgaaattattgctcatttgtatatctatctaccatcagtgtccaagaatttctgttctatcttaccaagagggagtatggttagtatttgaaattgtttattattttaataagtggttataacttttgagtcagtggtttatgttttgcattttttttgttttgagacaaagtctcgctctgtctcccaggctagagtaccgtggcacaatctcagctcattgcaacctctgcttcctgggctcaagcactctgcccacctcagcctccagagtagctggaaatacaggtatgcaccaccacaactggataacttttgtattttctgtagagagggttttacctttttgcccagtctgatcgcgaactcctgggctcaggcgatccacttgcctaggctccaaaagtgcttggtctacaggggtgaggcaccctgcctggcctcacctgtaggcttgttttttaaaatgaattttatctatttcccatttcattaatatatttaaaaataatgaaataacaaagacgtatgttggacttcattcattcttcagtgatgtcactttgctgcaaggaatatttggttttcttttttttttttttttccagatggagtctagctctgtctcctaagctacagtgaagtggcatgatctcggcccactgcaacctccacctcctgtgttcaagcgattctgcctcagcctcctgagtagctgggactacnggcatgtgccattatacctggctaattttatttatttattttagtagagatggggtttcaccatgttacccaggctgctctctaccttctgagctcaagtgatccacctgcctcggcctcccaaagtgctgggattacaggtgtcagccactgtacctggctgaatacttggttttcagtaccacaagaactatgagctggttatccacttcatgtggaatcataagcgtcccaaagtgacaatacatatagattgccaggcagtgaaacagttaagatgccaccatagctttcttttcaacatctttctaagattaccttactatttcttttgttccaagtttgtacttcctcacagttctcacatatggaaaggatacacactttgtagaaacaagaactttatgttatccaagttctaggatagccatgagctccaattatctcagagctctgagtcctctactcaatacccattgagatttatgtgttctgaggcttttgtcttctagctacttacttcattctccatgggtaacgtcattcatccacattaactaatttcctcactccaagctcttttctagagataatctccagtccctgtgcagaaactgtcattgcactttctgctgaaatggcagtttcttctcagcaaggtgagattatggaatccagaatcttttttcaggggtcacatgcccatttccccacttgcatgaatgtcgacactgcagccacagttttggccgtaaatgtgaatttggcaagtaaccactgttcccagggaaatgtcccaatcagaagaagattatctgggacactgatactgacagggagatgggacattctgagggacccggaggcagggtgccacctcctcaacttccctgagggctgcctagaatctgtttcctctcactctgaattattcttcctcttatggctgaccaaaaacatggaacctcacaaagtccactgtaacagctttatatttgtgaagtgaagaacatgaagacagtttcaagcaaagttattgagtggacactttgtgttttttttgagaagtctcactctttcacccaggctggagtgcagtggcacgatctcggctcactgcaactccacctcgttcaagtgattctcttgcctcagcctcccgagtagctgggcctataggttccctccaccacgcccagctaatttttgtatttttagtagagatgggctttcactacgttngccaggctggtctcaaactcctgacctcatgatccacccccctcggcctcctaaagtgctgggattacaggcatctgccaccgcactcggcttatccctagaaatcctatgatagcatgatgtataggcacctaaaggcatggcacttgagaaatgtgaataagattgtaagttacaaatagcaaggtacagtcagatgttaacagtctcagcccctaaatgtcaccttgtattacagcatgttatataagcacatacaggcacatacatgaaatagtgatacttcattctcagtaatatcttcatccttctcactggaaagatctttgatgatttttaatcaacataggagtttcaatgatatctagaagtttaaaagggctcgttcaaacaaattatgaccacacacactgaagagtatgtttgtctcttgtggtgtaaatttttttttattacaccaaattatgttcacacaaaacctttgtaatcagggggaattaaagagccttcctggaaaatggaggttgcaatcagccgagatggtgccatcgcactctagcctggggaatagagtgagatcctgcctcaaaaaaaacaaaaaaattctttattttctccataaactacagtttatataagcaaaagtttcagtactaagcaattttagtctctgcagtctcttgtcttgaattaatacaacttttgttaattctcttatgaagttaatcttcctgcttgtatgtgaattaaatatatgtcaaactttttttgtacaaaagattcatacctctttcctgtttgaaattattttactgtgtttcatcaatctaatgtttatttttattacaccagtaatttcctcattgtgttgaatcttacagtggcttataaatctacatgtacctag

SEQ ID NO: 369518 - DNA, 6158 bp, Homo sapiens
  misc_feature (4024)..(4024): n is a, c, g, or t
acgtatggtgcagtacattgattgaagtaacatgagagagaaggggtgggtgtagcaaaaacattctcaaggccaagtcatcagcccttacccttaggagggggcagtgattaagaggtggtatgagagcctcgtttctcatttctataagtgctggtaaaggacctgaccccacttccttacctactgcctgcccaggtaactgatgcctacagcatcacaggaattgccaaaatgcagaaaacaaatcctaaattgctctaattccataacacaaaggctggtttttggcttgaaataatcaggcacatatatcatgttctgtcacccagggtggagtgcagtggtgtgatctcggctcactacaaaccccgcctcctgggttcacgccattctccggcctcagcctcccgagtagctgggactacaggtgcccaccaccatgcccggctaattttttgtatttttagtagagacagggtttcaccatgttaaccagcatagtctctatcccctgactgcaagatctgcccgaatcagtgtcccaaagtgctgggattacaggcgtgagccaccgcacccagcccagaagggagtggacctttttatgtcaggacctcagcatggatacctatttgtccacctacttcttgttgctgatggcatttgaccagcaggcccatgaagagacaaaggcaccagtggatgtggtttcaactccgtgttggggaccttgggaggaggatgggcaagggtgggcgtgtgggagaggtgggttgtggtacctcagcagaggggctgcttgtggcttcatctgtcactatcatagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtacacaccaccacgcccagctaatttttgtgtttttagtggagatggggttttaccatgttggccaggctggtctcaaactcctgacctcaagtgatccacccaccttgactcccaaagtgctgaaattacaggcatgagcctctgcacctggccttcattcttttcgtattgcttagaatatgacatgctgaaccaggcatggtggctcatgcttgtaaacctgatgctttgggaggacaaggtggttcattggaggccaggagttggagatcagcctgggcaacatggccagacctcctctctacaaaaagaaaaaagaatgacatgcttcttgtttttgtctgttataaatgaaactgctatatttgaatgcagttgttcatgtaggtatgtttcactatggtaatatggtggtgtgcagtgcctgagtcacgtgatagattaaagtacaactcttttttgagacagagtctcactctgtcacccaggcgggagttaggtggcatgatttcggctcactgcaacctctgcctcccaagttcaactgattcttctgcctcagcctcccgagtagcagggattaccggtgtgcaccaccatgcctggataacttttttttttatttctattagcaatggggtttcaccatgctggccaggcttgttatgaactgacctcaagtgatctgcctgcctcagcttctcaggtgtgacctactgtgcttggcctaatgtacaactttttaagcaatgccaaactatgacttaagaatgaaattattgctcatttgtatatctatctaccatcagtgtccaagaatttctgttctatcttaccaagagggagtatggttagtatttgaaattgtttattattttaataagtggttataacttttgagtcagtggtttatgttttgcattttttttgttttgagacaaagtctcgctctgtctcccaggctagagtaccgtggcacaatctcagctcattgcaacctctgcttcctgggctcaagcactctgcccacctcagcctccagagtagctggaaatacaggtatgcaccaccacaactggataacttttgtattttctgtagagagggttttacctttttgcccagtctgatcgcgaactcctgggctcaggcgatccacttgcctaggctccaaaagtgcttggtctacaggggtgaggcaccctgcctggcctcacctgtaggcttgttttttaaaatgaattttatctatttcccatttcattaatatatttaaaaataatgaaataacaaagacgtatgttggacttcattcattcttcagtgatgtcactttgctgcaaggaatatttggttttcttttttttttttttttccagatggagtctagctctgtctcctaagctacagtgaagtggcatgatctcggcccactgcaacctccacctcctgtgttcaagcgattctgcctcagcctcctgagtagctgggactacnggcatgtgccattatacctggctaattttatttatttattttagtagagatggggtttcaccatgttacccaggctgctctctaccttctgagctcaagtgatccacctgcctcggcctcccaaagtgctgggattacaggtgtcagccactgtacctggctgaatacttggttttcagtaccacaagaactatgagctggttatccacttcatgtggaatcataagcgtcccaaagtgacaatacatatagattgccaggcagtgaaacagttaagatgccaccatagctttcttttcaacatctttctaagattaccttactatttcttttgttccaagtttgtacttcctcacagttctcacatatggaaaggatacacactttgtagaaacaagaactttatgttatccaagttctaggatagccatgagctccaattatctcagagctctgagtcctctactcaatacccattgagatttatgtgttctgaggcttttgtcttctagctacttacttcattctccatgggtaacgtcattcatccacattaactaatttcctcactccaagctcttttctagagataatctccagtccctgtgcagaaactgtcattgcactttctgctgaaatggcagtttcttctcagcaaggtgagattatggaatccagaatcttttttcaggggtcacatgcccatttccccacttgcatgaatgtcgacactgcagccacagttttggccgtaaatgtgaatttggcaagtaaccactgttcccagggaaatgtcccaatcagaagaagattatctgggacactgatactgacagggagatgggacattctgagggacccggaggcagggtgccacctcctcaacttccctgagggctgcctagaatctgtttcctctcactctgaattattcttcctcttatggctgaccaaaaacatggaacctcacaaagtccactgtaacagctttatatttgtgaagtgaagaacatgaagacagtttcaagcaaagttattgagtggacactttgtgttttttttgagaagtctcactctttcacccaggctggagtgcagtggcacgatctcggctcactgcaactccacctcccgggttcacgccattctcttgcctcagcctcctgagtagctgggaccacaagcgcccaccacgtcagcttaatttttttgttttgtttcttgagacagagtcttgctctcttgcccaggttggagtgccgtgtcgcaatctcagctcactgcaacttctacctcctggattcaagcacttctccttgcctcagccacctctttagctgggattacaggtgcgtgccaccacacccagctaatttttgtatttttagcagagaccaggtttcaccatgttggtcaggctggtctcaaactcctgacctcgtgatccacccacctcggcctcccaaagtgctggaattacaggcgtgagccactgcacctggcctgtattcttttctttagtagagacggggttttactgtatttgccaggatggtctcgatctccagacctcgtgatccgcccgccttagcctcccaaagtgctgggattataggcgtgagccaacacgccctggccacttcttgtctttgcaacattttttagatatgtatttgtgttttttggggagcttaatttgctaatggaatctctgttattttcctaacatgcttggtggatacaagagttaagacttcctgtcccgtttagtgtaacaaaagaaagttaagaaatgtggataaaagattgtaagttagaaatggcaagataatcagctatatgaagaatcttggccaggtgtggtggctgaggcctgtaatcccaccactttgggaggctgaggtgggcggatcacaaggtcaggagttcaagaccaccctggacaatattgtgaattcctgtctctactaaaaatacaaaaattagtcgggcatggtggcgggtgcctgtagtcccagctactcgggaggctgaggccagagaatcggttgaacctgggaggtggaaggtgcactgagccaatatcacaccagtgcactccaacctggtgacagagagacacatcatctcaaaa

SEQ ID NO: 369519 - DNA, 2608 bp, Homo sapiens
acgtatggtgcagtacattgattgaagtaacatgagagagaaggggtgggtgtagcaaaaacattctcaaggccaagtcatcagcccttacccttaggagggggcagtgattaagaggtggtatgagagcctcgtttctcatttctataagtgctggtaaaggacctgaccccacttccttacctactgcctgcccaggtaactgatgcctacagcatcacaggaattgccaaaatgcagaaaacaaatcctaaattgctctaattccataacacaaaggctggtttttggcttgaaataatcaggcacatatatcatgttctgtcacccagggtggagtgcagtggtgtgatctcggctcactacaaaccccgcctcctgggttcacgccattctccggcctcagcctcccgagtagctgggactacaggtgcccaccaccatgcccggctaattttttgtatttttagtagagacagggtttcaccatgttaaccagcatagtctctatcccctgactgcaagatctgcccgaatcagtgtcccaaagtgctgggattacaggcgtgagccaccgcacccagcccagaagggagtggacctttttatgtcaggacctcagcatggatacctatttgtccacctacttcttgttgctgatggcatttgaccagcaggcccatgaagagacaaaggcaccagtggatgtggtttcaactccgtgttggggaccttgggaggaggatgggcaagggtgggcgtgtgggagaggtgggttgtggtacctcagcagaggggctgcttgtggcttcatctgtcactatcatagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtgcagtgaatatgggaaatcgtttgctgaagcatcccgtctcgttaaacacaggagagttcatactggagaaaggccttatga

SEQ ID NO: 369520 - DNA, 1894 bp, Homo sapiens
  misc_feature (1813)..(1813): n is a, c, g, or t
  misc_feature (1890)..(1892): n is a, c, g, or t
acgtatggtgcagtacattgattgaagtaacatgagagagaaggggtgggtgtagcaaaaacattctcaaggccaagtcatcagcccttacccttaggagggggcagtgattaagaggtggtatgagagcctcgtttctcatttctataagtgctggtaaaggacctgaccccacttccttacctactgcctgcccaggtaactgatgcctacagcatcacaggaattgccaaaatgcagaaaacaaatcctaaattgctctaattccataacacaaaggctggtttttggcttgaaataatcaggcacatatatcatgttctgtcacccagggtggagtgcagtggtgtgatctcggctcactacaaaccccgcctcctgggttcacgccattctccggcctcagcctcccgagtagctgggactacaggtgcccaccaccatgcccggctaattttttgtatttttagtagagacagggtttcaccatgttaaccagcatagtctctatcccctgactgcaagatctgcccgaatcagtgtcccaaagtgctgggattacaggcgtgagccaccgcacccagcccagaagggagtggacctttttatgtcaggacctcagcatggatacctatttgtccacctacttcttgttgctgatggcatttgaccagcaggcccatgaagagacaaaggcaccagtggatgtggtttcaactccgtgttggggaccttgggaggaggatgggcaagggtgggcgtgtgggagaggtgggttgtggtacctcagcagaggggctgcttgtggcttcatctgtcactatcatagcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatccagtgtggccatgctggtgtagaatgaggttacccttgtgactaaaacatttcccacattccccacacttaaanggtctttctgtagtgtgaactcgctgatgattcctaaggtgtcctttttcattaaaagatttcccacagtcaaaaannnaa

SEQ ID NO: 369521 - DNA, 1244 bp, Homo sapiens
  misc_feature (1131)..(1131): n is a, c, g, or t
  misc_feature (1135)..(1135): n is a, c, g, or t
  misc_feature (1138)..(1139): n is a, c, g, or t
  misc_feature (1147)..(1147): n is a, c, g, or t
  misc_feature (1152)..(1153): n is a, c, g, or t
  misc_feature (1159)..(1160): n is a, c, g, or t
  misc_feature (1171)..(1171): n is a, c, g, or t
  misc_feature (1173)..(1173): n is a, c, g, or t
  misc_feature (1175)..(1176): n is a, c, g, or t
  misc_feature (1179)..(1180): n is a, c, g, or t
  misc_feature (1187)..(1187): n is a, c, g, or t
  misc_feature (1200)..(1200): n is a, c, g, or t
gggagttgaacggaaactacaactcccgagaggctgtgcggccaaagacacacgagaactacggaggcgagagactcgctcagccaactgccgctctcgtaaggctcgggctgcccttgcgctgccgatccgagacgttgctgcattcaggcattcgccgacgacagaccagcgcggggcggggttaggcggagggggcctgattcggattcgcggcagcgtcaggctcgcgggttctcgcgcggagaaggggtgcgagcggcggcggcggcggaggctgccatggacgacgaggaggagacgtaccggctctggaaaatccgcaagaccatcatgcagctgtgccacgaccgtggctatctggtgacccaggacgagcttgaccagaccctggaggagttcaaagcccaatttggggacaagccgagtgaggggcggccgcggcgcacggacctcaccgtgctggtggcccacaacgatgaccccaccgaccagatgtttgtgttctttccagaggagcccaaggtgggcatcaagaccatcaaggtgtactgccagcgcatgcaggaggagaacatcacacgggctctcatcgtggtgcagcagggcatgacaccctccgccaagcagtccctggtcgacatggcccccaagtacatcctggagcagtttctgcagcaggagctgctcatcaacatcacggagcacgagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcagtagctaccgcctgacagcccctagaggcggacacacagcgacccccatccctgcaggacaaacgcccctgccctgccagaatccggcccccacagctctcacggctgctgctcctctggactccccaaggcaggtggcctccacccacgttctcccgtcctggggtgaggcttcctgtggcccagcccgccccattcacctgtggatttgtgcgagagnttcnagnnaggcccgnggagnnccgggnntgtgccggttncnannccnnggccttnggggtgggcggtnccccgttctggggggtcccgttcccggcggggggcccggcgtta

SEQ ID NO: 369522 - DNA, 1007 bp, Homo sapiens
  misc_feature (22)..(22): n is a, c, g, or t
  misc_feature (24)..(25): n is a, c, g, or t
  misc_feature (923)..(923): n is a, c, g, or t
  misc_feature (951)..(951): n is a, c, g, or t
  misc_feature (973)..(973): n is a, c, g, or t
  misc_feature (976)..(977): n is a, c, g, or t
  misc_feature (980)..(980): n is a, c, g, or t
accacccccacccccgacaaancnntacggctaggtacgaggcctgagcggcggcggcggcggaggctgccatggacgacgaggaggagacgtaccggctctggaaaatccgcaagaccatcatgcagctgtgccacgaccgtggctatctggtgacccaggacgagcttgaccagaccctggaggagttcaaagcccaatttggggacaagccgagtgaggggcggccgcggcgcacggacctcaccgtgctggtggcccacaacgatgaccccaccgaccagatgtttgtgttctttccagaggagcccaaggtgggcatcaagaccatcaaggtgtactgccagcgcatgcaggaggagaacatcacacgggctctcatcgtggtgcagcagggcatgacaccctccgccaagcagtccctggtcgacatggcccccaagtacatcctggagcagtttctgcagcaggagctgctcatcaacatcacggagcacgagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcagtagctaccgcctgacagcccctagaggcggacacacagcgacccccatccctgcaggacaaacgcccctgccctgccagaatccggcccccacagctctcacggctgctgctcctctggactccccaaggcaggtggcctccacccacgttctcccgtcctggggtgaggcttcctgtggcccagcccgccccattcacctgtggatttgtgcgagaagctngagggacaggcccgaggaggctctgggnagtgtgcgggttaccagaccgnggnnccntgggttgggtcggtgcccttttcggcc

SEQ ID NO: 369523 - DNA, 864 bp, Homo sapiens
  misc_feature (22)..(22): n is a, c, g, or t
  misc_feature (24)..(25): n is a, c, g, or t
  misc_feature (735)..(735): n is a, c, g, or t
accacccccacccccgacaaancnntacggctaggtacgaggcctgagcggcggcggcggcggaggctgccatggacgacgaggaggagacgtaccggctctggaaaatccgcaagaccatcatgcagctgtgccacgaccgtggctatctggtgacccaggacgagcttgaccagaccctggaggagttcaaagcccaatttggggacaagccgagtgaggggcggccgcggcgcacggacctcaccgtgctggtggcccacaacgatgaccccaccgaccagatgtttgtgttctttccagaggagcccaaggtgggcatcaagaccatcaaggtgtactgccagcgcatgcaggaggagaacatcacacgggctctcatcgtggtgcagcagggcatgacaccctccgccaagcagtccctggtcgacatggcccccaagtacatcctggagcagtttctgcagcaggagctgctcatcaacatcacggagcacgagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcagtagctaccgcctgacagccctagaggcggacccngggacccatcctgggaaaggcctgcctgcagatcggcccaggtctcccggtgtgcttggtcccaggaggggctcacccgtttcccctgggggggccttgggcccccgcaaccttgggtggggggagcca

SEQ ID NO: 369524 - DNA, 350 bp, Homo sapiens
cccccaatcactcagtgagttaactagaacctgtcaattttgccttgtaaacttctttcaaataaaaaccacatccatatttccatccttgttcaaatgcacccttagttcaaatgtgtattatctcttgactggactattaaactaggcttctaacttttcctcgtgccgaattcggcacgagccggcctcggctctttactccattcacagccgtgcacgcgctcaagccaccagggtgcgagatgccagctctggagttctcggttgttgtaggaggttgggtgttttcaaatggtaaagatgttttgagcaaataaatttgcttgatacagaaaccaggccgacta

SEQ ID NO: 369525 - DNA, 3992 bp, Homo sapiens
gggagttgaacggaaactacaactcccgagaggctgtgcggccaaagacacacgagaactacggaggcgagagactcgctcagccaactgccgctctcgtaaggctcgggctgcccttgcgctgccgatccgagacgttgctgcattcaggcattcgccgacgacagaccagcgcggggcggggttaggcggagggggcctgattcggattcgcggcagcgtcaggctcgcgggttctcgcgcggagaaggggtgcgagcggcggcggcggcggaggctgccatggacgacgaggaggagacgtaccggctctggaaaatccgcaagaccatcatgcagctgtgccacgaccgtggctatctggtgacccaggacgagcttgaccagaccctggaggagttcaaagcccaatttggggacaagccgagtgaggggcggccgcggcgcacggacctcaccgtgctggtggcccacaacgatgaccccaccgaccagatgtttgtgttctttccagaggagcccaaggtgggcatcaagaccatcaaggtgtactgccagcgcatgcaggaggagaacatcacacgggctctcatcgtggtgcagcagggcatgacaccctccgccaagcagtccctggtcgacatggcccccaagtacatcctggagcagtttctgcagcaggagctgctcatcaacatcacggagcacgagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcagtagctaccgcctgacagcccctagaggcggacacacagcgacccccatccctgcaggacaaacgcccctgccctgccagaatccggcccccacagctctcacggctgctgctcctctggactccccaaggcaggtggcctccacccacgttctcccgtcctggggtgaggcttcctgtggcccagcccgccccattcacctgtggatttgtgcgagatgcagcctcagaaggaacaaggcccccagagggaggtcacctgggggcagctggtgccgggtcttcacccagaccacgctgggtcccctctgttgggggtttggggtccgggtctcccaccagccactgcttcctcctgggccctcggccttccacccctcgtcttccctccctcgggggccctgatgcgtggcggcccccgcccggcctcggctctttactccattcacagccgtgcacgcgctcaagccaccagggtgcgagatgccagctctggagttctcggttgttgtaggaggttgggtgttttcaaatggtaaagatgttttgagcaaataaatttgcttgatacagaaaccaggccgactaacaaggtttccagcaggtggccttgcctcaccccaagcacacgaggtcagcctggcaggtgtgccctcctcgcgctggcttcaggggtcagtgtctccccaggccctcgccctgccctcccacttcgtgctcctgggtaaggcgtgagcgtgtctgtctcttcccttcccgtgagggtgtggagttgttctctggcttgtgcagctgtggtttgcggccagttcctcttacagacgtttgggatctggctctacttccccgtttgcttactgtctgatttcagaaggcctcgcctgcccaagtttaacctagccacgtggttctctcacagtagctttattaagatgtaattcaccctcgggcggtcggtggtctgtaacgcgcccactgttctgtgcagcagggtccccagatccccaggccgcggactgtgtgtgtgatggggacagtgcttccccttctctccaaatgtacttttttcaaaattgtcttggccaaagcaagccagacccaaagggacaaacactgatgtcactcctaggaggtcactagagtcgtcagagactggaagtaggatgggggttcccgggactggggagttgggtggggatgggggttcccagggctggggaggagggaggggacagagtgtgtcatgtgcacagttttagtttgggaagatgagaaaattctggaggtggccgggcgcggtggctcacgcctgtaatcccagcactttgggaggccgaggtgggcggatcacctgaggtcgggagttcgagaccagcctgaccaacatggcaaaatcccatcactgcaaaaaatacaaaaattacctgggcgtggtggtgcatgcctgtaatcccagctacttgggagctaaggcaggagaatcacttgaacccaggaagtggaggatcgcttgagctcaggagttaaaagaccagcccgggcaacacagagaaaccccccacctctacaaaaaactttaagattacctgggcacagtggctcacacctgtaatcccaacactttgggaggctgaggcgggaggatcatttgagcccaggaggccgaggctgcagtgagctacgattgtgctcctgtactccagcctgggccacagggtcacaccctgtctcaaaaaaaaaaaaaaatgcagttccacaggcgcttgggccacgttcccagtgcttggtggccatgtggggctgacgtgcgaaaccttagagccgggggatacgtccgtcatcgagaacgttttcctggactgccctgggctgcaggtggacgtgacgaggtcattcgatgcctgaccgtctgcacagcctgtggtgaagaccacccgggctcccacctcgcggggccccgtggcggggggttcccttcctcacacatccctcccctagggggaggcccagggccacgccacggggctctctctgtcccctccctggccccttcttctaagcttgcagctgccacagaaaatcttctaagcttgcagctgccacagaaaacacccgattaaaaactttttatttcagcaaaataaacgtgcctgtgaaagaaccacacggtggcttccgagagaccccactgtgtacctgagccccaggtggccacacctggtgttctggaaaagggagtccagggccagtattcaggccctgctgtactgcaccctggaaactgcaccaaaccccagctccgcccccatccacggctcccagaatggtttctggagtccctgcaacagacctgtgaggagagggcagggcagggcctgcctcctgcgtccccgtgatgacctgggggatgcactgggcagggacagcttcctccatccacacagccctgtgggcaccaacaaggccactgtgacttcacacgacagcagtgttccccagctcagctgagccggggtgcaggggacagcacagggcacagtcctgtgccgcaaggccctcgtgctcctggaagcctctgggaggaggcgcccgctggtgggacgtcgaagtccaggcgctctcggcagcgaccccaggacggcgcacctaagctatgccgtggtgcaggggacgtgctggagggacaggagcaggcaagagagaagccacctgtggtcccagccccaccccagctcacacgaattccggctgcctttccctgcaggagcccagcgtcatccgcccgccacggagcctcatggggggcagtggggcctgcagcacgttgttggactggttggtgttgaatcctgagagctgctgggccgggccgtcctcgtccccgtccccgtcctcccgggctgtggcctccagctgctcctcactgccgctgtggctgccagaagccacctctaggctggcctcgctctgctgctgctccaggaagctgaggtggcccagggcactggcctccgatgaggacagcagctcggaggcctcctctaggtccgagtccgaatcgttggacacaactcgggattct

SEQ ID NO: 369526 - DNA, 1287 bp, Homo sapiens
  misc_feature (22)..(22): n is a, c, g, or t
  misc_feature (24)..(25): n is a, c, g, or t
accacccccacccccgacaaancnntacggctaggtacgaggcctgagcggcggcggcggcggaggctgccatggacgacgaggaggagacgtaccggctctggaaaatccgcaagaccatcatgcagctgtgccacgaccgtggctatctggtgacccaggacgagcttgaccagaccctggaggagttcaaagcccaatttggggacaagccgagtgaggggcggccgcggcgcacggacctcaccgtgctggtggcccacaacgatgaccccaccgaccagatgtttgtgttctttccagaggagcccaaggtgggcatcaagaccatcaaggtgtactgccagcgcatgcaggaggagaacatcacacgggctctcatcgtggtgcagcagggcatgacaccctccgccaagcagtccctggtcgacatggcccccaagtacatcctggagcagtttctgcagcaggagctgctcatcaacatcacggagcacgagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcagtagctaccgcctgacagcccctagaggcggacacacagcgacccccatccctgcaggacaaacgcccctgccctgccagaatccggcccccacagctctcacggctgctgctcctctggactccccaaggcaggtggcctccacccacgttctcccgtcctggggtgaggcttcctgtggcccagcccgccccattcacctgtggatttgtgcgagatgcagcctcagaaggaacaaggcccccagagggaggtcacctgggggcagctggtgccgggtcttcacccagaccacgctgggtcccctctgttgggggtttggggtccgggtctcccaccagccactgcttcctcctgggccctcggccttccacccctcgtcttccctccctcgggggccctgatgcgtggcggcccccgcccggcctcggctctttactccattcacagccgtgcacgcgctcaagccaccagggtgcgagatgccagctctggagttctcggttgttgtaggaggttgggtgttttcaaatggtaaagatgttttgagcaaataaatttgcttgatacagaaaccaggccgacta

SEQ ID NO: 369527 - DNA, 1298 bp, Homo sapiens
  misc_feature (1)..(2): n is a, c, g, or t
  misc_feature (9)..(9): n is a, c, g, or t
  misc_feature (11)..(11): n is a, c, g, or t
  misc_feature (21)..(21): n is a, c, g, or t
  misc_feature (23)..(23): n is a, c, g, or t
  misc_feature (38)..(38): n is a, c, g, or t
nngtcaccngnggtgccgccngnctagaactagtgganccccggcctgcaggaattgagcggcggcggcggcggaggctgccatggacgacgaggaggagacgtaccggctctggaaaatccgcaagaccatcatgcagctgtgccacgaccgtggctatctggtgacccaggacgagcttgaccagaccctggaggagttcaaagcccaatttggggacaagccgagtgaggggcggccgcggcgcacggacctcaccgtgctggtggcccacaacgatgaccccaccgaccagatgtttgtgttctttccagaggagcccaaggtgggcatcaagaccatcaaggtgtactgccagcgcatgcaggaggagaacatcacacgggctctcatcgtggtgcagcagggcatgacaccctccgccaagcagtccctggtcgacatggcccccaagtacatcctggagcagtttctgcagcaggagctgctcatcaacatcacggagcacgagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcagtagctaccgcctgacagcccctagaggcggacacacagcgacccccatccctgcaggacaaacgcccctgccctgccagaatccggcccccacagctctcacggctgctgctcctctggactccccaaggcaggtggcctccacccacgttctcccgtcctggggtgaggcttcctgtggcccagcccgccccattcacctgtggatttgtgcgagatgcagcctcagaaggaacaaggcccccagagggaggtcacctgggggcagctggtgccgggtcttcacccagaccacgctgggtcccctctgttgggggtttggggtccgggtctcccaccagccactgcttcctcctgggccctcggccttccacccctcgtcttccctccctcgggggccctgatgcgtggcggcccccgcccggcctcggctctttactccattcacagccgtgcacgcgctcaagccaccagggtgcgagatgccagctctggagttctcggttgttgtaggaggttgggtgttttcaaatggtaaagatgttttgagcaaataaatttgcttgatacagaaaccaggccgacta

SEQ ID NO: 369528 - DNA, 3940 bp, Homo sapiens
gggagttgaacggaaactacaactcccgagaggctgtgcggccaaagacacacgagaactacggaggcgagagactcgctcagccaactgccgctctcgtaaggctcgggctgcccttgcgctgccgatccgagacgttgctgcattcaggcattcgccgacgacagaccagcgcggggcggggttaggcggagggggcctgattcggattcgcggcagcgtcaggctcgcgggttctcgcgcggagaaggggtgcgagcggcggcggcggcggaggctgccatggacgacgaggaggagacgtaccggctctggaaaatccgcaagaccatcatgcagctgtgccacgaccgtggctatctggtgacccaggacgagcttgaccagaccctggaggagttcaaagcccaatttggggacaagccgagtgaggggcggccgcggcgcacggacctcaccgtgctggtggcccacaacgatgaccccaccgaccagatgtttgtgttctttccagaggagcccaaggtgggcatcaagaccatcaaggtgtactgccagcgcatgcaggaggagaacatcacacgggctctcatcgtggtgcagcagggcatgacaccctccgccaagcagtccctggtcgacatggcccccaagtacatcctggagcagtttctgcagcaggagctgctcatcaacatcacggagcacgagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcagtagctaccgcctgacagcccctagaggcggacacacagcgacccccatccctgcaggacaaacgcccctgccctgccagaatccggcccccacagctctcacggctgctgctcctctggactccccaaggcaggtggcctccacccacgttctcccgtcctggggtgaggcttcctgtggcccagcccgccccattcacctgtggatttgtgcgagatgcagcctcagaaggaacaaggcccccagagggaggtcacctgggggcagctggtgccgggtcttcacccagaccacgctgggtcccctctgttgggggtttggggtccgggtctcccaccagccactgcttcctcctgggccctcggccttccacccctcgtcttccctccctcgggggccctgatgcgtggcggcccccgcccggcctcggctctttactccattcacagccgtgcacgcgctcaagccaccagggtgcgagatgccagctctggagttctcggttgttgtaggaggttgggtgttttcaaatggtaaagatgttttgagcaaataaatttgcttgatacagaaaccaggccgactaacaaggtttccagcaggtggccttgcctcaccccaagcacacgaggtcagcctggcaggtgtgccctcctcgcgctggcttcaggggtcagtgtctccccaggccctcgccctgccctcccacttcgtgctcctgggtaaggcgtgagcgtgtctgtctcttcccttcccgtgagggtgtggagttgttctctggcttgtgcagctgtggtttgcggccagttcctcttacagacgtttgggatctggctctacttccccgtttgcttactgtctgatttcagaaggcctcgcctgcccaagtttaacctagccacgtggttctctcacagtagctttattaagatgtaattcaccctcgggcggtcggtggtctgtaacgcgcccactgttctgtgcagcagggtccccagatccccaggccgcggactgtgtgtgtgatggggacagtgcttccccttctctccaaatgtacttttttcaaaattgtcttggccaaagcaagccagacccaaagggacaaacactgatgtcactcctaggaggtcactagagtcgtcagagactggaagtaggatgggggttcccgggactggggagttgggtggggatgggggttcccagggctggggaggagggaggggacagagtgtgtcatgtgcacagttttagtttgggaagatgagaaaattctggaggtggccgggcgcggtggctcacgcctgtaatcccagcactttgggaggccgaggtgggcggatcacctgaggtcgggagttcgagaccagcctgaccaacatggcaaaatcccatcactgcaaaaaatacaaaaattacctgggcgtggtggtgcatgcctgtaatcccagctacttgggagctaaggcaggagaatcacttgaacccaggaagtggaggatcgcttgagctcaggagttaaaagaccagcccgggcaacacagagaaaccccccacctctacaaaaaactttaagattacctgggcacagtggctcacacctgtaatcccaacactttgggaggctgaggcgggaggatcatttgagcccaggaggccgaggctgcagtgagctacgattgtgctcctgtactccagcctgggccacagggtcacaccctgtctcaaaaaaaaaaaaaaatgcagttccacaggcgcttgggccacgttcccagtgcttggtggccatgtggggctgacgtgcgaaaccttagagccgggggatacgtccgtcatcgagaacgttttcctggactgccctgggctgcaggtggacgtgacgaggtcattcgatgcctgaccgtctgcacagcctgtggtgaagaccacccgggctcccacctcgcggggccccgtggcggggggttcccttcctcacacatccctcccctagggggaggcccagggccacgccacggggctctctctgtcccctccctggccccttcttctaagcttgcagctgccacagaaaatcttctaagcttgcagctgccacagaaaacacccgattaaaaactttttatttcagcaaaataaacgtgcctgtgaaagaaccacacggtggcttccgagagaccccactgtgtacctgagccccaggtggccacacctggtgttctggaaaagggagtccagggccagtattcaggccctgctgtactgcaccctggaaactgcaccaaaccccagctccgcccccatccacggctcccagaatggtttctggagtccctgcaacagacctgtgaggagagggcaggggacagcttcctccatccacacagccctgtgggcaccaacaaggccactgtgacttcacacgacagcagtgttccccagctcagctgagccggggtgcaggggacagcacagggcacagtcctgtgccgcaaggccctcgtgctcctggaagcctctgggaggaggcgcccgctggtgggacgtcgaagtccaggcgctctcggcagcgaccccaggacggcgcacctaagctatgccgtggtgcaggggacgtgctggagggacaggagcaggcaagagagaagccacctgtggtcccagccccaccccagctcacacgaattccggctgcctttccctgcaggagcccagcgtcatccgcccgccacggagcctcatggggggcagtggggcctgcagcacgttgttggactggttggtgttgaatcctgagagctgctgggccgggccgtcctcgtccccgtccccgtcctcccgggctgtggcctccagctgctcctcactgccgctgtggctgccagaagccacctctaggctggcctcgctctgctgctgctccaggaagctgaggtggcccagggcactggcctccgatgaggacagcagctcggaggcctcctctaggtccgagtccgaatcgttggacacaactcgggattct

SEQ ID NO: 369529 - DNA, 1348 bp, Homo sapiens
  misc_feature (1317)..(1317): n is a, c, g, or t
gggagttgaacggaaactacaactcccgagaggctgtgcggccaaagacacacgagaactacggaggcgagagactcgctcagccaactgccgctctcgtaaggctcgggctgcccttgcgctgccgatccgagacgttgctgcattcaggcattcgccgacgacagaccagcgcggggcggggttaggcggagggggcctgattcggattcgcggcagcgtcaggctcgcgggttctcgcgcggagaaggggtgcgagcggcggcggcggcggaggctgccatggacgacgaggaggagacgtaccggctctggaaaatccgcaagaccatcatgcagctgtgccacgaccgtggctatctggtgacccaggacgagcttgaccagaccctggaggagttcaaagcccaatttggggacaagccgagtgaggggcggccgcggcgcacggacctcaccgtgctggtggcccacaacgatgaccccaccgaccagatgtttgtgttctttccagaggagcccaaggtgggcatcaagaccatcaaggtgtactgccagcgcatgcaggaggagaacatcacacgggctctcatcgtggtgcagcagggcatgacaccctccgccaagcagtccctggtcgacatggcccccaagtacatcctggagcagtttctgcagcaggagctgctcatcaacatcacggagcacgagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcagtagctaccgcctgacagcccctagaggcggacacacagcgacccccatccctgcaggacaaacgcccctgccctgccagaatccggcccccacagctctcacggctgctgctcctctggactccccaaggcaggtggcctccacccacgttctcccgtcctggggtgaggcttcctgtggcccagcccgccccattcacctgtggatttgtgcgagatgcagcctcagaaggaacaaggcccccagagggaggtcacctgggggcagctggtgccgggtcttcacccagaccacgctgggtcccctctgttgggggtttggggtccgggtctcccaccagccactgcttcctcctgggccctcggccttccacccctcgtcttccctccctcgggggccagctgnaggggagtcgtataactaccgcagagcagtt

SEQ ID NO: 369530 - DNA, 1218 bp, Homo sapiens
  misc_feature (1134)..(1134): n is a, c, g, or t
  misc_feature (1162)..(1162): n is a, c, g, or t
  misc_feature (1184)..(1184): n is a, c, g, or t
  misc_feature (1187)..(1188): n is a, c, g, or t
  misc_feature (1191)..(1191): n is a, c, g, or t
gggagttgaacggaaactacaactcccgagaggctgtgcggccaaagacacacgagaactacggaggcgagagactcgctcagccaactgccgctctcgtaaggctcgggctgcccttgcgctgccgatccgagacgttgctgcattcaggcattcgccgacgacagaccagcgcggggcggggttaggcggagggggcctgattcggattcgcggcagcgtcaggctcgcgggttctcgcgcggagaaggggtgcgagcggcggcggcggcggaggctgccatggacgacgaggaggagacgtaccggctctggaaaatccgcaagaccatcatgcagctgtgccacgaccgtggctatctggtgacccaggacgagcttgaccagaccctggaggagttcaaagcccaatttggggacaagccgagtgaggggcggccgcggcgcacggacctcaccgtgctggtggcccacaacgatgaccccaccgaccagatgtttgtgttctttccagaggagcccaaggtgggcatcaagaccatcaaggtgtactgccagcgcatgcaggaggagaacatcacacgggctctcatcgtggtgcagcagggcatgacaccctccgccaagcagtccctggtcgacatggcccccaagtacatcctggagcagtttctgcagcaggagctgctcatcaacatcacggagcacgagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcagtagctaccgcctgacagcccctagaggcggacacacagcgacccccatccctgcaggacaaacgcccctgccctgccagaatccggcccccacagctctcacggctgctgctcctctggactccccaaggcaggtggcctccacccacgttctcccgtcctggggtgaggcttcctgtggcccagcccgccccattcacctgtggatttgtgcgagaagctngagggacaggcccgaggaggctctgggnagtgtgcgggttaccagaccgnggnnccntgggttgggtcggtgcccttttcggcc

SEQ ID NO: 369531 - DNA, 1246 bp, Homo sapiens
aggtacggattgcgagcgtgcgggtaggcagagagctgcgaggaggagacgtaccggctctggaaaatccgcaagaccatcatgcagctgtgccacgaccgtggctatctggtgacccaggacgagcttgaccagaccctggaggagttcaaagcccaatttggggacaagccgagtgaggggcggccgcggcgcacggacctcaccgtgctggtggcccacaacgatgaccccaccgaccagatgtttgtgttctttccagaggagcccaaggtgggcatcaagaccatcaaggtgtactgccagcgcatgcaggaggagaacatcacacgggctctcatcgtggtgcagcagggcatgacaccctccgccaagcagtccctggtcgacatggcccccaagtacatcctggagcagtttctgcagcaggagctgctcatcaacatcacggagcacgagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcagtagctaccgcctgacagcccctagaggcggacacacagcgacccccatccctgcaggacaaacgcccctgccctgccagaatccggcccccacagctctcacggctgctgctcctctggactccccaaggcaggtggcctccacccacgttctcccgtcctggggtgaggcttcctgtggcccagcccgccccattcacctgtggatttgtgcgagatgcagcctcagaaggaacaaggcccccagagggaggtcacctgggggcagctggtgccgggtcttcacccagaccacgctgggtcccctctgttgggggtttggggtccgggtctcccaccagccactgcttcctcctgggccctcggccttccacccctcgtcttccctccctcgggggccctgatgcgtggcggcccccgcccggcctcggctctttactccattcacagccgtgcacgcgctcaagccaccagggtgcgagatgccagctctggagttctcggttgttgtaggaggttgggtgttttcaaatggtaaagatgttttgagcaaataaatttgcttgatacagaaaccaggccgacta

SEQ ID NO: 369532 - DNA, 1043 bp, Homo sapiens
gaattcactagtgattgtgagctgagatcgcaccgaccagatgtttgtgttctttccagaggagcccaaggtgggcatcaagaccatcaaggtgtactgccagcgcatgcaggaggagaacatcacacgggctctcatcgtggtgcagcagggcatgacaccctccgccaagcagtccctggtcgacatggcccccaagtacatcctggagcagtttctgcagcaggagctgctcatcaacatcacggagcacgagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcagtagctaccgcctgacagcccctagaggcggacacacagcgacccccatccctgcaggacaaacgcccctgccctgccagaatccggcccccacagctctcacggctgctgctcctctggactccccaaggcaggtggcctccacccacgttctcccgtcctggggtgaggcttcctgtggcccagcccgccccattcacctgtggatttgtgcgagatgcagcctcagaaggaacaaggcccccagagggaggtcacctgggggcagctggtgccgggtcttcacccagaccacgctgggtcccctctgttgggggtttggggtccgggtctcccaccagccactgcttcctcctgggccctcggccttccacccctcgtcttccctccctcgggggccctgatgcgtggcggcccccgcccggcctcggctctttactccattcacagccgtgcacgcgctcaagccaccagggtgcgagatgccagctctggagttctcggttgttgtaggaggttgggtgttttcaaatggtaaagatgttttgagcaaataaatttgcttgatacagaaaccaggccgacta

SEQ ID NO: 369533 - DNA, 1075 bp, Homo sapiens
  misc_feature (946)..(946): n is a, c, g, or t
gggagttgaacggaaactacaactcccgagaggctgtgcggccaaagacacacgagaactacggaggcgagagactcgctcagccaactgccgctctcgtaaggctcgggctgcccttgcgctgccgatccgagacgttgctgcattcaggcattcgccgacgacagaccagcgcggggcggggttaggcggagggggcctgattcggattcgcggcagcgtcaggctcgcgggttctcgcgcggagaaggggtgcgagcggcggcggcggcggaggctgccatggacgacgaggaggagacgtaccggctctggaaaatccgcaagaccatcatgcagctgtgccacgaccgtggctatctggtgacccaggacgagcttgaccagaccctggaggagttcaaagcccaatttggggacaagccgagtgaggggcggccgcggcgcacggacctcaccgtgctggtggcccacaacgatgaccccaccgaccagatgtttgtgttctttccagaggagcccaaggtgggcatcaagaccatcaaggtgtactgccagcgcatgcaggaggagaacatcacacgggctctcatcgtggtgcagcagggcatgacaccctccgccaagcagtccctggtcgacatggcccccaagtacatcctggagcagtttctgcagcaggagctgctcatcaacatcacggagcacgagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcagtagctaccgcctgacagccctagaggcggacccngggacccatcctgggaaaggcctgcctgcagatcggcccaggtctcccggtgtgcttggtcccaggaggggctcacccgtttcccctgggggggccttgggcccccgcaaccttgggtggggggagcca

SEQ ID NO: 369534 - DNA, 611 bp, Homo sapiens
  misc_feature (22)..(22): n is a, c, g, or t
  misc_feature (24)..(25): n is a, c, g, or t
accacccccacccccgacaaancnntacggctaggtacgaggcctgagcggcggcggcggcggaggctgccatggacgacgaggaggagacgtaccggctctggaaaatccgcaagaccatcatgcaggtgagccgcgcctggtatctggtgacgcaggtggcctccacccacgttctcccgtcctggggtgaggcttcctgtggcccagcccgccccattcacctgtggatttgtgcgagatgcagcctcagaaggaacaaggcccccagagggaggtcacctgggggcagctggtgccgggtcttcacccagaccacgctgggtcccctctgttgggggtttggggtccgggtctcccaccagccactgcttcctcctgggccctcggccttccacccctcgtcttccctccctcgggggccctgatgcgtggcggcccccgcccggcctcggctctttactccattcacagccgtgcacgcgctcaagccaccagggtgcgagatgccagctctggagttctcggttgttgtaggaggttgggtgttttcaaatggtaaagatgttttgagcaaataaatttgcttgatacagaaaccaggccgacta

SEQ ID NO: 369535 - DNA, 679 bp, Homo sapiens
gggagttgaacggaaactacaactcccgagaggctgtgcggccaaagacacacgagaactacggaggcgagagactcgctcagccaactgccgctctcgtaaggctcgggctgcccttgcgctgccgatccgagacgttgctgcattcaggcattcgccgacgacagaccagcgcggggcggggttaggcggagggggcctgattcggattcgcggcagcgtcaggctcgcgggttctcgcgcggagaaggggtgcgagcggcggcggcggcggaggctgccatggacgacgaggaggagacgtaccggctctggaaaatccgcaagaccatcatgcagctgtgccacgaccgtggctatctggtgacccaggacgagcttgaccagaccctggaggagttcaaagcccaatttggggacaagccgagtgaggggcggccgcggcgcacggacctcaccgtgctggtggcccacaacgatgaccccaccgaccagatgtttgtgttctttccagaggagcccaaggtgggcatcaagaccatcaaggtgtactgccagcgcatgcaggaggagaacatcacacgggctctcatcgtggtgcagcaggaattctcgcgggagcagcaggaattctcgcgggagcagcaggaattctcgcgggagcaggaattctcgcggg

SEQ ID NO: 369536 - DNA, 749 bp, Homo sapiens
gggagttgaacggaaactacaactcccgagaggctgtgcggccaaagacacacgagaactacggaggcgagagactcgctcagccaactgccgctctcgtaaggctcgggctgcccttgcgctgccgatccgagacgttgctgcattcaggcattcgccgacgacagaccagcgcggggcggggttaggcggagggggcctgattcggattcgcggcagcgtcaggctcgcgggttctcgcgcggagaaggggtgcgagcggcggcggcggcggaggctgccatggacgacgaggaggagacgtaccggctctggaaaatccgcaagaccatcatgcagctgtgccacgaccgtggctatctggtgacccaggacgagcttgaccagaccctggaggagttcaaagcccaatttggggacaagccgagtgaggggcggccgcggcgcacggacctcaccgtgctggtggcccacaacgatgaccccaccgaccagatgtttgtgttctttccaggtgagcagcgggtcccgggggagttccggtgaagccaccagagcacctgccgaggagccggtcgctagcacccacccccactcgcctggtgcccagcatttgtctctctgcccagtctgggaggaaaactcccctccccttccttgctgtgggtgatgccgttgatctctgacccctctcatgctcagcttctttctagtttccctctcagtccccttctctcttcctgccaacg

SEQ ID NO: 369537 - DNA, 507 bp, Homo sapiens
gccacacagagcagcacccctgtatggggaagaggtcgccctgccagctctgagggccgcccctggaagcgtgtgatggatggaaacacatccgagtttccacggccacttcactgctggatgaggctctcgatgagcagagaggctggggaggggcgggctgttgaaggctcctgggctggcggtggggttttctgattcacgacgtgggtgtgttgttggggcacacgagtaagccccaggtagcttgaggcaggaaatggggttggggttgtctgggcccctccgggccgtgccttagagccgctctcttccagtccctggtcgacatggcccccaagtacatcctggagcagtttctgcagcaggagctgctcatcaacatcacggagcacgaggtgggcgcgcgccgcggaatcccgcctgcgtggggccggcagagatgcagcgtttgtgggtggccaggaagatgtgggatctggggcccagggcaggtgttcctattag

SEQ ID NO: 369538 - DNA, 1230 bp, Homo sapiens
  misc_feature (930)..(930): n is a, c, g, or t
  misc_feature (944)..(945): n is a, c, g, or t
gggagttgaacggaaactacaactcccgagaggctgtgcggccaaagacacacgagaactacggaggcgagagactcgctcagccaactgccgctctcgtaaggctcgggctgcccttgcgctgccgatccgagacgttgctgcattcaggcattcgccgacgacagaccagcgcggggcggggttaggcggagggggcctgattcggattcgcggcagcgtcaggctcgcgggttctcgcgcggagaaggggtgcgagcggcggcggcggcggaggctgccatggacgacgaggaggagacgtaccggctctggaaaatccgcaagaccatcatgcagctgtgccacgaccgtggctatctggtgacccaggacgagcttgaccagaccctggaggagttcaaagcccaatttggggacaagccgagtgaggggcggccgcggcgcacggacctcaccgtgctggtggcccacaacgatgaccccaccgaccagatgtttgtgttctttccagaggagcccaaggtgggcatcaagaccatcaaggtgtactgccagcgcatgcaggaggagaacatcacacgggctctcatcgtggtgcagcagggcatgacaccctccgccaagcagtccctggtcgacatggcccccaagtacatcctggagcagtttctgcagcaggagctgctcatcaacatcacggagcacgagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcagtagctaccgcctgacagncctagagcggacannggacccatcctgtcggacaaagccctaactgccaaatcggcccaagacataaaggaggagtccttggagcccaaggaggtgcatcacccagaataccgagcatgggagaagcgcacaagagccaaccggccatagcgtatgattcggcgaaaaacacagacaaccgaggaagagaacccatatagcgctgttacaaacaaggggctacactgccaagactgtagttaggagaggggacccagacgagggtaaataacaagagtacgatgcacagagacgcgaact

SEQ ID NO: 369539 - DNA, 1498 bp, Homo sapiens
gggagttgaacggaaactacaactcccgagaggctgtgcggccaaagacacacgagaactacggaggcgagagactcgctcagccaactgccgctctcgtaaggctcgggctgcccttgcgctgccgatccgagacgttgctgcattcaggcattcgccgacgacagaccagcgcggggcggggttaggcggagggggcctgattcggattcgcggcagcgtcaggctcgcgggttctcgcgcggagaaggggtgcgagcggcggcggcggcggaggctgccatggacgacgaggaggagacgtaccggctctggaaaatccgcaagaccatcatgcagctgtgccacgaccgtggctatctggtgacccaggacgagcttgaccagaccctggaggagttcaaagcccaatttggggacaagccgagtgaggggcggccgcggcgcacggacctcaccgtgctggtggcccacaacgatgaccccaccgaccagatgtttgtgttctttccagaggagcccaaggtgggcatcaagaccatcaaggtgtactgccagcgcatgcaggaggagaacatcacacgggctctcatcgtggtgcagcagggcatgacaccctccgccaagcagtccctggtcgacatggcccccaagtacatcctggagcagtttctgcagcaggagctgctcatcaacatcacggagcacgagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcagtagctaccgcctgacagcccctagaggcggacacacagcgacccccatccctgcaggacaaacgcccctgccctgccagaatccggcccccacagctctcacggctgctgctcctctggactccccaaggcaggtggcctccacccacgttctcccgtcctggggtgaggcttcctgtggcccagcccgccccattcacctgtggatttgtgcgagatgcagcctcagaaggaacaaggcccccagagggaggtcacctgggggcagctggtgccgggtcttcacccagaccacgctgggtcccctctgttgggggtttggggtccgggtctcccaccagccactgcttcctcctgggccctcggccttccacccctcgtcttccctccctcgggggccctgatgcgtggcggcccccgcccggcctcggctctttactccattcacagccgtgcacgcgctcaagccaccagggtgcgagatgccagctctggagttctcggttgttgtaggaggttgggtgttttcaaatggtaaagatgttttgagcaaataaatttgcttgatacagaaaccaggccgacta

SEQ ID NO: 369540 - DNA, 2965 bp, Homo sapiens
gggagttgaacggaaactacaactcccgagaggctgtgcggccaaagacacacgagaactacggaggcgagagactcgctcagccaactgccgctctcgtaaggctcgggctgcccttgcgctgccgatccgagacgttgctgcattcaggcattcgccgacgacagaccagcgcggggcggggttaggcggagggggcctgattcggattcgcggcagcgtcaggctcgcgggttctcgcgcggagaaggggtgcgagcggcggcggcggcggaggctgccatggacgacgaggaggagacgtaccggctctggaaaatccgcaagaccatcatgcagctgtgccacgaccgtggctatctggtgacccaggacgagcttgaccagaccctggaggagttcaaagcccaatttggggacaagccgagtgaggggcggccgcggcgcacggacctcaccgtgctggtggcccacaacgatgaccccaccgaccagatgtttgtgttctttccagaggagcccaaggtgggcatcaagaccatcaaggtgtactgccagcgcatgcaggaggagaacatcacacgggctctcatcgtggtgcagcagggcatgacaccctccgccaagcagtccctggtcgacatggcccccaagtacatcctggagcagtttctgcagcaggagctgctcatcaacatcacggagcacgagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcagtagctaccgcctgacagcccctagaggcggacacacagcgacccccatccctgcaggacaaacgcccctgccctgccagaatccggcccccacagctctcacggctgctgctcctctggactccccaaggcaggtggcctccacccacgttctcccgtcctggggtgaggcttcctgtggcccagcccgccccattcacctgtggatttgtgcgagatgcagcctcagaaggaacaaggcccccagagggaggtcacctgggggcagctggtgccgggtcttcacccagaccacgctgggtcccctctgttgggggtttggggtccgggtctcccaccagccactgcttcctcctgggccctcggccttccacccctcgtcttccctccctcgggggccctgatgcgtggcggcccccgcccggcctcggctctttactccattcacagccgtgcacgcgctcaagccaccagggtgcgagatgccagctctggagttctcggttgttgtaggaggttgggtgttttcaaatggtaaagatgttttgagcaaataaatttgcttgatacagaaaccaggccgactaacaaggtttccagcaggtggccttgcctcaccccaagcacacgaggtcagcctggcaggtgtgccctcctcgcgctggcttcaggggtcagtgtctccccaggccctcgccctgccctcccacttcgtgctcctggttccacaggcgcttgggccacgttcccagtgcttggtggccatgtggggctgacgtgcgaaaccttagagccgggggatacgtccgtcatcgagaacgttttcctggactgccctgggctgcaggtggacgtgacgaggtcattcgatgcctgaccgtctgcacagcctgtggtgaagaccacccgggctcccacctcgcggggccccgtggcggggggttcccttcctcacacatccctcccctagggggaggcccagggccacgccacggggctctctctgtcccctccctggccccttcttctaagcttgcagctgccacagaaaatcttctaagcttgcagctgccacagaaaacacccgattaaaaactttttatttcagcaaaataaacgtgcctgtgaaagaaccacacggtggcttccgagagaccccactgtgtacctgagccccaggtggccacacctggtgttctggaaaagggagtccagggccagtattcaggccctgctgtactgcaccctggaaactgcaccaaaccccagctccgcccccatccacggctcccagaatggtttctggagtccctgcaacagacctgtgaggagagggcagggcagggcctgcctcctgcgtccccgtgatgacctgggggatgcactgggcagggacagcttcctccatccacacagccctgtgggcaccaacaaggccactgtgacttcacacgacagcagtgttccccagctcagctgagccggggtgcaggggacagcacagggcacagtcctgtgccgcaaggccctcgtgctcctggaagcctctgggaggaggcgcccgctggtgggacgtcgaagtccaggcgctctcggcagcgaccccaggacggcgcacctaagctatgccgtggtgcaggggacgtgctggagggacaggagcaggcaagagagaagccacctgtggtcccagccccaccccagctcacacgaattccggctgcctttccctgcaggagcccagcgtcatccgcccgccacggagcctcatggggggcagtggggcctgcagcacgttgttggactggttggtgttgaatcctgagagctgctgggccgggccgtcctcgtccccgtccccgtcctcccgggctgtggcctccagctgctcctcactgccgctgtggctgccagaagccacctctaggctggcctcgctctgctgctgctccaggaagctgaggtggcccagggcactggcctccgatgaggacagcagctcggaggcctcctctaggtccgagtccgaatcgttggacacaactcgggattct

SEQ ID NO: 369541 - DNA, 1402 bp, Homo sapiens
gggagttgaacggaaactacaactcccgagaggctgtgcggccaaagacacacgagaactacggaggcgagagactcgctcagccaactgccgctctcgtaaggctcgggctgcccttgcgctgccgatccgagacgttgctgcattcaggcattcgccgacgacagaccagcgcggggcggggttaggcggagggggcctgattcggattcgcggcagcgtcaggctcgcgggttctcgcgcggagaaggggtgcgagcggcggcggcggcggaggctgccatggacgacgaggaggagacgtaccggctctggaaaatccgcaagaccatcatgcagctgtgccacgaccgtggctatctggtgacccaggacgagcttgaccagaccctggaggagttcaaagcccaatttggggacaagccgagtgaggggcggccgcggcgcacggacctcaccgtgctggtggcccacaacgatgaccccaccgaccagatgtttgtgttctttccagaggagcccaaggtgggcatcaagaccatcaaggtgtactgccagcgcatgcaggaggagaacatcacacgggctctcatcgtggtgcagcagggcatgacaccctccgccaagcagtccctggtcgacatggcccccaagtacatcctggagcagtttctgcagcaggagctgctcatcaacatcacggagcacgagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcagtagctaccgcctgacagcccctagaggcggacacacagcgacccccatccctgcaggacaaacgcccctgccctgccagaatccggcccccacagctctcacggctgctgctcctctggactccccaaggcaggtggcctccacccacgttctcccgtcctggggtgaggcttcctgtggcccagcccgccccattcacctgtggatttgtgcgagatgcagcctcagaaggaacaaggcccccagagggaggtcacctgggccctcggccttccacccctcgtcttccctccctcgggggccctgatgcgtggcggcccccgcccggcctcggctctttactccattcacagccgtgcacgcgctcaagccaccagggtgcgagatgccagctctggagttctcggttgttgtaggaggttgggtgttttcaaatggtaaagatgttttgagcaaataaatttgcttgatacagaaaccaggccgacta

SEQ ID NO: 369542 - DNA, 1112 bp, Homo sapiens
  misc_feature (22)..(22): n is a, c, g, or t
  misc_feature (24)..(25): n is a, c, g, or t
accacccccacccccgacaaancnntacggctaggtacgaggcctgagcggcggcggcggcggaggctgccatggacgacgaggaggagacgtaccggctctggaaaatccgcaagaccatcatgcagaggagcccaaggtgggcatcaagaccatcaaggtgtactgccagcgcatgcaggaggagaacatcacacgggctctcatcgtggtgcagcagggcatgacaccctccgccaagcagtccctggtcgacatggcccccaagtacatcctggagcagtttctgcagcaggagctgctcatcaacatcacggagcacgagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcagtagctaccgcctgacagcccctagaggcggacacacagcgacccccatccctgcaggacaaacgcccctgccctgccagaatccggcccccacagctctcacggctgctgctcctctggactccccaaggcaggtggcctccacccacgttctcccgtcctggggtgaggcttcctgtggcccagcccgccccattcacctgtggatttgtgcgagatgcagcctcagaaggaacaaggcccccagagggaggtcacctgggggcagctggtgccgggtcttcacccagaccacgctgggtcccctctgttgggggtttggggtccgggtctcccaccagccactgcttcctcctgggccctcggccttccacccctcgtcttccctccctcgggggccctgatgcgtggcggcccccgcccggcctcggctctttactccattcacagccgtgcacgcgctcaagccaccagggtgcgagatgccagctctggagttctcggttgttgtaggaggttgggtgttttcaaatggtaaagatgttttgagcaaataaatttgcttgatacagaaaccaggccgacta

SEQ ID NO: 369543 - DNA, 1417 bp, Homo sapiens
gggagttgaacggaaactacaactcccgagaggctgtgcggccaaagacacacgagaactacggaggcgagagactcgctcagccaactgccgctctcgtaaggctcgggctgcccttgcgctgccgatccgagacgttgctgcattcaggcattcgccgacgacagaccagcgcggggcggggttaggcggagggggcctgattcggattcgcggcagcgtcaggctcgcgggttctcgcgcggagaaggggtgcgagcggcggcggcggcggaggctgccatggacgacgaggaggagacgtaccggctctggaaaatccgcaagaccatcatgcagctgtgccacgaccgtggctatctggtgacccaggacgagcttgaccagaccctggaggagttcaaagcccaatttggggacaagccgagtgaggggcggccgcggcgcacggacctcaccgtgctggtggcccacaacgatgaccccaccgaccagatgtttgtgttctttccagaggagcccaaggtgggcatcaagaccatcaaggtgtactgccagcgcatgcaggaggagaacatcacacgggctctcatcgtggtgcagcagggcatgacaccctccgccaagcagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcagtagctaccgcctgacagcccctagaggcggacacacagcgacccccatccctgcaggacaaacgcccctgccctgccagaatccggcccccacagctctcacggctgctgctcctctggactccccaaggcaggtggcctccacccacgttctcccgtcctggggtgaggcttcctgtggcccagcccgccccattcacctgtggatttgtgcgagatgcagcctcagaaggaacaaggcccccagagggaggtcacctgggggcagctggtgccgggtcttcacccagaccacgctgggtcccctctgttgggggtttggggtccgggtctcccaccagccactgcttcctcctgggccctcggccttccacccctcgtcttccctccctcgggggccctgatgcgtggcggcccccgcccggcctcggctctttactccattcacagccgtgcacgcgctcaagccaccagggtgcgagatgccagctctggagttctcggttgttgtaggaggttgggtgttttcaaatggtaaagatgttttgagcaaataaatttgcttgatacagaaaccaggccgacta

SEQ ID NO: 369544 - DNA, 3815 bp, Homo sapiens
gggagttgaacggaaactacaactcccgagaggctgtgcggccaaagacacacgagaactacggaggcgagagactcgctcagccaactgccgctctcgtaaggctcgggctgcccttgcgctgccgatccgagacgttgctgcattcaggcattcgccgacgacagaccagcgcggggcggggttaggcggagggggcctgattcggattcgcggcagcgtcaggctcgcgggttctcgcgcggagaaggggtgcgagcggcggcggcggcggaggctgccatggacgacgaggaggagacgtaccggctctggaaaatccgcaagaccatcatgcagctgtgccacgaccgtggctatctggtgacccaggacgagcttgaccagaccctggaggagttcaaagcccaatttggggacaagccgagtgaggggcggccgcggcgcacggacctcaccgtgctggtggcccacaacgatgaccccaccgaccagatgtttgtgttctttccagaggagcccaaggtgggcatcaagaccatcaaggtgtactgccagcgcatgcaggaggagaacatcacacgggctctcatcgtggtgcagcagggcatgacaccctccgccaagcagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcagtagctaccgcctgacagcccctagaggcggacacacagcgacccccatccctgcaggacaaacgcccctgccctgccagaatccggcccccacagctctcacggctgctgctcctctggactccccaaggcaggtggcctccacccacgttctcccgtcctggggtgaggcttcctgtggcccagcccgccccattcacctgtggatttgtgcgagatgcagcctcagaaggaacaaggcccccagagggaggtcacctgggccctcggccttccacccctcgtcttccctccctcgggggccctgatgcgtggcggcccccgcccggcctcggctctttactccattcacagccgtgcacgcgctcaagccaccagggtgcgagatgccagctctggagttctcggttgttgtaggaggttgggtgttttcaaatggtaaagatgttttgagcaaataaatttgcttgatacagaaaccaggccgactaacaaggtttccagcaggtggccttgcctcaccccaagcacacgaggtcagcctggcaggtgtgccctcctcgcgctggcttcaggggtcagtgtctccccaggccctcgccctgccctcccacttcgtgctcctgggtaaggcgtgagcgtgtctgtctcttcccttcccgtgagggtgtggagttgttctctggcttgtgcagctgtggtttgcggccagttcctcttacagacgtttgggatctggctctacttccccgtttgcttactgtctgatttcagaaggcctcgcctgcccaagtttaacctagccacgtggttctctcacagtagctttattaagatgtaattcaccctcgggcggtcggtggtctgtaacgcgcccactgttctgtgcagcagggtccccagatccccaggccgcggactgtgtgtgtgatggggacagtgcttccccttctctccaaatgtacttttttcaaaattgtcttggccaaagcaagccagacccaaagggacaaacactgatgtcactcctaggaggtcactagagtcgtcagagactggaagtaggatgggggttcccgggactggggagttgggtggggatgggggttcccagggctggggaggagggaggggacagagtgtgtcatgtgcacagttttagtttgggaagatgagaaaattctggaggtggccgggcgcggtggctcacgcctgtaatcccagcactttgggaggccgaggtgggcggatcacctgaggtcgggagttcgagaccagcctgaccaacatggcaaaatcccatcactgcaaaaaatacaaaaattacctgggcgtggtggtgcatgcctgtaatcccagctacttgggagctaaggcaggagaatcacttgaacccaggaagtggaggatcgcttgagctcaggagttaaaagaccagcccgggcaacacagagaaaccccccacctctacaaaaaactttaagattacctgggcacagtggctcacacctgtaatcccaacactttgggaggctgaggcgggaggatcatttgagcccaggaggccgaggctgcagtgagctacgattgtgctcctgtactccagcctgggccacagggtcacaccctgtctcaaaaaaaaaaaaaaatgcagttccacaggcgcttgggccacgttcccagtgcttggtggccatgtggggctgacgtgcgaaaccttagagccgggggatacgtccgtcatcgagaacgttttcctggactgccctgggctgcaggtggacgtgacgaggtcattcgatgcctgaccgtctgcacagcctgtggtgaagaccacccgggctcccacctcgcggggccccgtggcggggggttcccttcctcacacatccctcccctagggggaggcccagggccacgccacggggctctctctgtcccctccctggccccttcttctaagcttgcagctgccacagaaaatcttctaagcttgcagctgccacagaaaacacccgattaaaaactttttatttcagcaaaataaacgtgcctgtgaaagaaccacacggtggcttccgagagaccccactgtgtacctgagccccaggtggccacacctggtgttctggaaaagggagtccagggccagtattcaggccctgctgtactgcaccctggaaactgcaccaaaccccagctccgcccccatccacggctcccagaatggtttctggagtccctgcaacagacctgtgaggagagggcagggcagggcctgcctcctgcgtccccgtgatgacctgggggatgcactgggcagggacagcttcctccatccacacagccctgtgggcaccaacaaggccactgtgacttcacacgacagcagtgttccccagctcagctgagccggggtgcaggggacagcacagggcacagtcctgtgccgcaaggccctcgtgctcctggaagcctctgggaggaggcgcccgctggtgggacgtcgaagtccaggcgctctcggcagcgaccccaggacggcgcacctaagctatgccgtggtgcaggggacgtgctggagggacaggagcaggcaagagagaagccacctgtggtcccagccccaccccagctcacacgaattccggctgcctttccctgcaggagcccagcgtcatccgcccgccacggagcctcatggggggcagtggggcctgcagcacgttgttggactggttggtgttgaatcctgagagctgctgggccgggccgtcctcgtccccgtccccgtcctcccgggctgtggcctccagctgctcctcactgccgctgtggctgccagaagccacctctaggctggcctcgctctgctgctgctccaggaagctgaggtggcccagggcactggcctccgatgaggacagcagctcggaggcctcctctaggtccgagtccgaatcgttggacacaactcgggattct

SEQ ID NO: 369545 - DNA, 1124 bp, Homo sapiens
gggagttgaacggaaactacaactcccgagaggctgtgcggccaaagacacacgagaactacggaggcgagagactcgctcagccaactgccgctctcgtaaggctcgggctgcccttgcgctgccgatccgagacgttgctgcattcaggcattcgccgacgacagaccagcgcggggcggggttaggcggagggggcctgattcggattcgcggcagcgtcaggctcgcgggttctcgcgcggagaaggggtgcgagcggcggcggcggcggaggctgccatggacgacgaggaggagacgtaccggctctggaaaatccgcaagaccatcatgcagctgtgccacgaccgtggctatctggtgacccaggacgagcttgaccagaccctggaggagttcaaagcccaatttggggacaagccgagtgaggggcggccgcggcgcacggacctcaccgtgctggtggcccacaacgatgaccccaccgaccagatgtttgtgttctttccagaggagcccaaggtgggcatcaagaccatcaaggtgtactgccagcgcatgcaggaggagaacatcacacgggctctcatcgtggtgcagcagggcatgacaccctccgccaagcagtccctggtcgacatggcccccaagtacatcctggagcagtttctgcagcaggagctgctcatcaacatcacggagcacgagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaaaatccatccggacaagtgagaaagggtggcaggtacatcacatacggtggtgcaggtaggtaccgcatgaccatgccctagaggtggacacacaagtgaaccacatccatgtaggacgaaagccctgtctgctagatacgggaccaaagttctcacgatgtggtctttggaatccaaggagtggctcaccacgtttcaggactgggtaggctcttgtggccaggcagcctacattgattggggcagaggtaaaggacagcccaagag

SEQ ID NO: 369546 - DNA, 1096 bp, Homo sapiens
tcactcacagatctgctccactggtgcaaactgtgttaattggtggttctggtctcacagacttcagatgagcgcagacctcacgtgagtgtcacagttcttaaagaatgtgtgtccagagtgatcagggctgagacaatggagtgcagggggtgggggactcctgactcagcaaggaaggtcctggagggctttctggagtggggagctatctgagctgagacttggagggatgagaagcaggagaggactcctcctcccttaggccgtctctcttcaccgtgtaacaagctgtcatggcatgcttgctcggctctgggtgcccttttgctgaacaatactggggatccagcacggaccagatgagctctggtccctgccctcatccagttgcagtctagagaattagagaattatggagagtgtggcaggtgccctgaagggaagcaacaggatacaagaaaaaatgatggggccaggcacggtggctcacgcctgtaaccccagcaatttggcaggccgaagtgggtggattgcttgagcccaggagttcgagaccagcctgggcaatgtggtgagacccccgtctctacaaaaatgttttaaaaattggttgggcgtggtggcgcatgcctgtatactcagctactagggtggccgacgtgggcttgagcccaggaggtcaaggctgcagtgagctgtgattgtgccactgcactccagcctgggcaacggagagagactctgtctcaaaaataagataaactgaaattaaaaaataggctgggctggccgggcgtggtggctcacgcctgtaatctcagcactttgggaggccgaggcgggtggatcacgaggtcaggagatcgagaccatcttggctaacacggtgaaaccccatctctcctaaaaatacaaaaaattagccaggcgtggtggcgggcgcctgtagtcccagctactcaggaggctgaggcaggagaatggcgtgaacccgggaggcagagtttgcagtgagccgagatcgtgccactgcactccagcctgggcgacagagcgagactctgtctcagaaaaaaaaaaaaaaaaaaaaaaa

SEQ ID NO: 369547 - DNA, 769 bp, Homo sapiens
ccacttcttccacccccgggagtccaggcctccctgtccccacagtccctgagccacaagcctccaccccagctggtcccccacccaggctgcccagtttaacattcctagtcataggaccttgacttctgagaggcctgattgtcatctgtaaataaggggtaggactaaagcactcctcctggaggactgagagatgggctggaccggagcacttgagtctgggatatgtgaccatgctacctttgtctccctgtcctgttccttcccccagccccaaatccagggttttccaaagtgtggttcaagaaccacctgcatctgaatctagaggtactggatacaaccccacgtctgggccgttacccaggacattctacatgagaacgtgggggtggggccctggctgcacctgaactgtcacctggagtcagggtggaaggtggaagaactgggtcttatttccttctccccttgttctttagggtctgtccttctgcagactccgttaccccaccctaaccatcctgcacacccttggagccctctgggccaatgccctgtcccgcaaagggcttctcaggcatctcacctctatgggagggcatttttggcccccagaaccttacacggtgtttatgtggggaagcccctgggaagcagacagtcctagggtgaagctgagaggcagagagaaggggagacagacagagggaaacaccggtgtttccctttgtctaggctggagtgcagtgccacaatcatagct

SEQ ID NO: 369548 - DNA, 942 bp, Homo sapiens
ctgggactacaggtgcgcactatcatacctggctaatttttttttttgagatggagtctcgctctgtcgcccaggctggagtgcagtggcgcgatctcggctcactgcaacctctgcctcccgggttcacgccattcttctgtctcagcctccccagcagctgggactacaggcgcccagcaccacgcccagctaatttttttgtatttttagtagagacgggatttcaccgtgttagtcaggatagtctcgatctcctgacctcgtgatctgcccgcctcggcctcccaaagtgctggaattaaaggcgtgagccaccacacccggccaatttttgtatttttggtagagatggggtttcaccatgttggccaggctggtctcaaacacctgaccttgtgatccgcccacctcggcctcccgaagtgctgggattacaggcatgagccaccgcgcccggccattctttgagttttcatcaaccagtggatacagaagtgtgctgcccattttgcagattagagaattgaggctagtaaataagtcgggacttagttgatgcccttgctctttgagttctgggctctggaggctttggattcaaagccctgctgcaccatttactcatcatgtgactttgggaaggtgaccattctctgagccttacttctcctcctctgcaaaatgggattccagttcctaccttgcaggaccgctgttgtagaatcatacatggagattgctcagtcctgggccaacttggcctacgaggagataccagtaaacgaccttatccgcgggcagggactgctcttggcttctgtctcattctctctggtccagaggaggtgttccataaatattctcagaatgagtgaatggctgaagggagtgaacggaacagtcagtggattaaaaattcattagctcatccattcacaa

SEQ ID NO: 369549 - DNA, 343 bp, Homo sapiens
tttttttttacttcagacatgggacggtctctgtagttacagtggggcattaagtaagggtgtgtgtgttgctggggatctgagaagtcgatctttgagctgagcgctggtgaaggagaaacaagccatggaaggaaaggtgccaagtggtcaggcgagagcctccagggcaaaggccttgggcaggtgggaatcctgatttgttctcaactacgcgaggcagaggctcggaaccgggacctagaggcacacgtccggcagttgcaggagcggatggagttgctgcaggcagagggagccacagacaggtgagtccctcatgtgtccccttccccggaggacc

SEQ ID NO: 369550 - DNA, 6513 bp, Homo sapiens
cggctgcgggcggcagtccggcagtggcggggcccggggggcgcccaagatggcggcgggcggcgcggagggcggctcgggccccggcgccgccatgggggactgcgcggagattaagtcgcaattccgcacgcgcgagggtttctacaagctactcccgggcgacggcgccgctcgcaggtcgggtccggcttccgcccagactccggtgccgcctcagccaccgcagcccccgcccggccctgcctccgcctccggtcccggcgctgcaggccccgcgtcgtccccgccgcccgcaggccccggacccgggcccgccctgcccgccgtgcgcctcagcctcgtgcgcctcggggagccggacagcgccggggccggggagccgcccgccacgcccgcggggctgggctcggggggagaccgcgtctgcttcaacttgggccgtgagctctatttctacccaggctgctgtcgtcgtgggagccaacggtccattgacctcaacaagccaattgacaagcggatctacaagggcacccagcccacctgccacgatttcaaccagttcactgctgccaccgagaccatctcgctgctggtgggcttctcagcgggtcaagtgcagtacctggatctcatcaaaaaggacaccagcaagctgttcaatgaggagcggttgatcgacaagaccaaggtgacatatctgaagtggctgcctgagtcggagagcctgttcctggcatcacacgccagtggccacctgtacctgtacaacgtcagccacccctgcgcctcggccccgccccagtacagcctgctgaagcagggcgagggcttctctgtctatgctgccaagagcaaggcaccccgcaacccgctggccaagtgggcggtgggtgaggggcccctcaacgagttcgccttctcgcccgatggccggcacctggcctgtgtgagccaggatggctgcctgcgcgtcttccacttcgactccatgctcctgcgtgggctcatgaagagctactttgggggcctgctgtgtgtgtgctggagccctgacggccgctacgtggtgacgggtggcgaagatgacctggtcaccgtgtggtccttcaccgagggccgcgtggtggctcgaggccatggccacaagtcctgggtcaacgctgtggcctttgacccctacaccacaagggcagaggaggcggcgacagcagccggtgctgatggggagcggagcggcgaagaggaggaggaggagcccgaggctgcgggcacaggctcggccgggggcgccccgctctctccactgcccaaggctggctccattacttaccgctttggctcggcgggccaggacacgcagttctgcctgtgggacctcactgaagacgtgctctacccgcacccgcccctggcccgcacccgcaccctccctggcacacctggcaccacgccaccggccgccagcagctcgaggggtggcgagcctggcccaggccccctgcctcgctcgctgtcccgctccaacagtctcccgcacccagctggcgggggcaaggcgggcggcccgggtgtggcggcagagcctggcacaccattcagcattggccgcttcgccacgctcacactgcaggagcggcgggaccggggggcagagaaggagcacaagcgctaccacagcctgggcaacatcagccggggtggcagtggcggcagtggcagtggtggggagaagcccagcggccctgttccccgcagccgcctggaccccgccaaggtgctgggcactgcgctgtgcccgcgcatccacgaggtgcccctgctggagccccttgtgtgcaagaagatcgcccaggagcggctcacagtcctcctgttcctggaggactgcatcatcactgcctgccaggagggcctcatctgcacctgggcccggccgggcaaggcgggcatctcctcccaaccaggcaactccccgagtggcacagtggtgtgaagccatggatatcgggcccccccaaccccatgcccccagcctcctagccataaccctccctgctgacctcacagatcaacgtattaacaagactaaccatgatggatggactgctccagtccccccacctgcacaaaatttgggggccccccagactggcccggacacgggcgatgtaatagcccttgtggcctcagccttgtcccccacccactgccaagtacaatgacctcttcctctgaaacatcagtgttaccctcatccctgtccccagcatgtgactggtcactcctggggagagactccccgcccctgccacaagagccccaggtctgcagtgtgcccctcagttgagtgggcagggccgggggtggtccagccctcgcccggcccccaccccagctgcccttgctattgtctgtgcttttgaagagtgttaaattatggaagcccctcaggttcctccctgtcccgcaggacctcttatttatactaaagttccctgttttctcagcgggtctgtccccttcggaggagatgatgtagaggacctgtgtgtgtactctgtggttctaggcagtccgctttccccagaggaggagtgcaggcctgctcccagcccagcgcctcccaccccttttcatagcaggaaaagccggagcccagggagggaacggacctgcgagtcacacaactggtgacccacaccagcggctggagcaggaccctcttggggagaagagcatcctgcccgcagccagggcccctcatcaaagtcctcggtgttttttaaattatcagaactgcccaggaccacgtttcccaggccctgcccagctgggactcctcggtccttgcctcctagtttctcaggcctggccctctcaaggcccaggcaccccaggccggttggaggccccgacttccactctggagaaccgtccaccctggaaagaagagctcagattcctcttggctctcggagccgcagggagtgtgtcttcccgcgccaccctccaccccccgaaatgtttctgtttctaatcccagcctgggcaggaatgtggctccccggccaggggccaaggagctattttggggtctcgtttgcccagggagggcttggctccaccactttcctcccccagcctttgggcagcaggtcacccctgttcaggctctgagggtgccccctcctggtcctgtcctcaccaccccttccccacctcctgggaaaaaaaaaaaaaaaaaaaaaaaagctggtataaagcagagagcctgagggctaaatttaactgtccgagtcggaatccatctctgagtcacccaagaagctgccctggcctcccgtccccttcccaggcctcaacccctttctcccacccagccccaacccccagccctcaccccctagcccccagttctggagcttgtcgggagcaagggggtggttgctactgggtcactcagcctcaattggccctgtttcagcaatgggcaggttcttcttgaaattcatcacacctgtggcttcctctgtgctctacctttttattggggtgacagtgtgacagctgagattctccatgcattccccctactctagcactgaagggttctgaagggccctggaaggagggagcttggggggctggcttgtgaggggttaaggctgggaggcgggaggggggctggaccaaggggtggggagaaggggaggaggcctcggccggccgcagagagaagtggccagagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgtgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgccca

SEQ ID NO: 369551 - DNA, 5972 bp, Homo sapiens
cggctgcgggcggcagtccggcagtggcggggcccggggggcgcccaagatggcggcgggcggcgcggagggcggctcgggccccggcgccgccatgggggactgcgcggagattaagtcgcaattccgcacgcgcgagggtttctacaagctactcccgggcgacggcgccgctcgcaggtcgggtccggcttccgcccagactccggtgccgcctcagccaccgcagcccccgcccggccctgcctccgcctccggtcccggcgctgcaggccccgcgtcgtccccgccgcccgcaggccccggacccgggcccgccctgcccgccgtgcgcctcagcctcgtgcgcctcggggagccggacagcgccggggccggggagccgcccgccacgcccgcggggctgggctcggggggagaccgcgtctgcttcaacttgggccgtgagctctatttctacccaggctgctgtcgtcgtgggagccaacggtccattgacctcaacaagccaattgacaagcggatctacaagggcacccagcccacctgccacgatttcaaccagttcactgctgccaccgagaccatctcgctgctggtgggcttctcagcgggtcaagtgcagtacctggatctcatcaaaaaggacaccagcaagctgttcaatgaggagcggttgatcgacaagaccaaggtgacatatctgaagtggctgcctgagtcggagagcctgttcctggcatcacacgccagtggccacctgtacctgtacaacgtcagccacccctgcgcctcggccccgccccagtacagcctgctgaagcagggcgagggcttctctgtctatgctgccaagagcaaggcaccccgcaacccgctggccaagtgggcggtgggtgaggggcccctcaacgagttcgccttctcgcccgatggccggcacctggcctgtgtgagccaggatggctgcctgcgcgtcttccacttcgactccatgctcctgcgtgggctcatgaagagctactttgggggcctgctgtgtgtgtgctggagccctgacggccgctacgtggtgacgggtggcgaagatgacctggtcaccgtgtggtccttcaccgagggccgcgtggtggctcgaggccatggccacaagtcctgggtcaacgctgtggcctttgacccctacaccacaagggcagaggaggcggcgacagcagccggtgctgatggggagcggagcggcgaagaggaggaggaggagcccgaggctgcgggcacaggctcggccgggggcgccccgctctctccactgcccaaggctggctccattacttaccgctttggctcggcgggccaggacacgcagttctgcctgtgggacctcactgaagacgtgctctacccgcacccgcccctggcccgcacccgcaccctccctggcacacctggcaccacgccaccggccgccagcagctcgaggggtggcgagcctggcccaggccccctgcctcgctcgctgtcccgctccaacagtctcccgcacccagctggcgggggcaaggcgggcggcccgggtgtggcggcagagcctggcacaccattcagcattggccgcttcgccacgctcacactgcaggagcggcgggaccggggggcagagaaggagcacaagcgctaccacagcctgggcaacatcagccggggtggcagtggcggcagtggcagtggtggggagaagcccagcggccctgttccccgcagccgcctggaccccgccaagagccccaggtctgcagtgtgcccctcagttgagtgggcagggccgggggtggtccagccctcgcccggcccccaccccagctgcccttgctattgtctgtgcttttgaagagtgttaaattatggaagcccctcaggttcctccctgtcccgcaggacctcttatttatactaaagttccctgttttctcagcgggtctgtccccttcggaggagatgatgtagaggacctgtgtgtgtactctgtggttctaggcagtccgctttccccagaggaggagtgcaggcctgctcccagcccagcgcctcccaccccttttcatagcaggaaaagccggagcccagggagggaacggacctgcgagtcacacaactggtgacccacaccagcggctggagcaggaccctcttggggagaagagcatcctgcccgcagccagggcccctcatcaaagtcctcggtgttttttaaattatcagaactgcccaggaccacgtttcccaggccctgcccagctgggactcctcggtccttgcctcctagtttctcaggcctggccctctcaaggcccaggcaccccaggccggttggaggccccgacttccactctggagaaccgtccaccctggaaagaagagctcagattcctcttggctctcggagccgcagggagtgtgtcttcccgcgccaccctccaccccccgaaatgtttctgtttctaatcccagcctgggcaggaatgtggctccccggccaggggccaaggagctattttggggtctcgtttgcccagggagggcttggctccaccactttcctcccccagcctttgggcagcaggtcacccctgttcaggctctgagggtgccccctcctggtcctgtcctcaccaccccttccccacctcctgggaaaaaaaaaaaaaaaaaaaaaaaagctggtataaagcagagagcctgagggctaaatttaactgtccgagtcggaatccatctctgagtcacccaagaagctgccctggcctcccgtccccttcccaggcctcaacccctttctcccacccagccccaacccccagccctcaccccctagcccccagttctggagcttgtcgggagcaagggggtggttgctactgggtcactcagcctcaattggccctgtttcagcaatgggcaggttcttcttgaaattcatcacacctgtggcttcctctgtgctctacctttttattggggtgacagtgtgacagctgagattctccatgcattccccctactctagcactgaagggttctgaagggccctggaaggagggagcttggggggctggcttgtgaggggttaaggctgggaggcgggaggggggctggaccaaggggtggggagaaggggaggaggcctcggccggccgcagagagaagtggccagagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgtgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgccca

SEQ ID NO: 369552 - DNA, 8655 bp, Homo sapiens
cggctgcgggcggcagtccggcagtggcggggcccggggggcgcccaagatggcggcgggcggcgcggagggcggctcgggccccggcgccgccatgggggactgcgcggagattaagtcgcaattccgcacgcgcgagggtttctacaagctactcccgggcgacggcgccgctcgcaggtcgggtccggcttccgcccagactccggtgccgcctcagccaccgcagcccccgcccggccctgcctccgcctccggtcccggcgctgcaggccccgcgtcgtccccgccgcccgcaggccccggacccgggcccgccctgcccgccgtgcgcctcagcctcgtgcgcctcggggagccggacagcgccggggccggggagccgcccgccacgcccgcggggctgggctcggggggagaccgcgtctgcttcaacttgggccgtgagctctatttctacccaggctgctgtcgtcgtgggagccaacggtccattgacctcaacaagccaattgacaagcggatctacaagggcacccagcccacctgccacgatttcaaccagttcactgctgccaccgagaccatctcgctgctggtgggcttctcagcgggtcaagtgcagtacctggatctcatcaaaaaggacaccagcaagctgttcaatgaggagcggttgatcgacaagaccaaggtgacatatctgaagtggctgcctgagtcggagagcctgttcctggcatcacacgccagtggccacctgtacctgtacaacgtcagccacccctgcgcctcggccccgccccagtacagcctgctgaagcagggcgagggcttctctgtctatgctgccaagagcaaggcaccccgcaacccgctggccaagtgggcggtgggtgaggggcccctcaacgagttcgccttctcgcccgatggccggcacctggcctgtgtgagccaggatggctgcctgcgcgtcttccacttcgactccatgctcctgcgtgggctcatgaagagctactttgggggcctgctgtgtgtgtgctggagccctgacggccgctacgtggtgacgggtggcgaagatgacctggtcaccgtgtggtccttcaccgagggccgcgtggtggctcgaggccatggccacaagtcctgggtcaacgctgtggcctttgacccctacaccacaagggcagaggaggcggcgacagcagccggtgctgatggggagcggagcggcgaagaggaggaggaggagcccgaggctgcgggcacaggctcggccgggggcgccccgctctctccactgcccaaggctggctccattacttaccgctttggctcggcgggccaggacacgcagttctgcctgtgggacctcactgaagacgtgctctacccgcacccgcccctggcccgcacccgcaccctccctggcacacctggcaccacgccaccggccgccagcagctcgaggggtggcgagcctggcccaggccccctgcctcgctcgctgtcccgctccaacagtctcccgcacccagctggcgggggcaaggcgggcggcccgggtgtggcggcagagcctggcacaccattcagcattggccgcttcgccacgctcacactgcaggagcggcgggaccggggggcagagaaggagcacaagcgctaccacagcctgggcaacatcagccggggtggcagtggcggcagtggcagtggtggggagaagcccagcggccctgttccccgcagccgcctggaccccgccaaggtgctgggcactgcgctgtgcccgcgcatccacgaggtgcccctgctggagccccttgtgtgcaagaagatcgcccaggagcggctcacagtcctcctgttcctggaggactgcatcatcactgcctgccaggagggcctcatctgcacctgggcccggccgggcaaggcgttcacagacgaggagaccgaggcccagacaggggaaggaagttggcccaggtcacccagcaagtcagtggtagagggcatctcctcccaaccaggcaactccccgagtggcacagtggtgtgaagccatggatatcgggcccccccaaccccatgcccccagcctcctagccataaccctccctgctgacctcacagatcaacgtattaacaagactaaccatgatggatggactgctccagtccccccacctgcacaaaatttgggggccccccagactggcccggacacgggcgatgtaatagcccttgtggcctcagccttgtcccccacccactgccaagtacaatgacctcttcctctgaaacatcagtgttaccctcatccctgtccccagcatgtgactggtcactcctggggagagactccccgcccctgccacaagagccccaggtctgcagtgtgcccctcagttgagtgggcagggccgggggtggtccagccctcgcccggcccccaccccagctgcccttgctattgtctgtgcttttgaagagtgttaaattatggaagcccctcaggttcctccctgtcccgcaggacctcttatttatactaaagttccctgttttctcagcgggtctgtccccttcggaggagatgatgtagaggacctgtgtgtgtactctgtggttctaggcagtccgctttccccagaggaggagtgcaggcctgctcccagcccagcgcctcccaccccttttcatagcaggaaaagccggagcccagggagggaacggacctgcgagtcacacaactggtgacccacaccagcggctggagcaggaccctcttggggagaagagcatcctgcccgcagccagggcccctcatcaaagtcctcggtgttttttaaattatcagaactgcccaggaccacgtttcccaggccctgcccagctgggactcctcggtccttgcctcctagtttctcaggcctggccctctcaaggcccaggcaccccaggccggttggaggccccgacttccactctggagaaccgtccaccctggaaagaagagctcagattcctcttggctctcggagccgcagggagtgtgtcttcccgcgccaccctccaccccccgaaatgtttctgtttctaatcccagcctgggcaggaatgtggctccccggccaggggccaaggagctattttggggtctcgtttgcccagggagggcttggctccaccactttcctcccccagcctttgggcagcaggtcacccctgttcaggctctgagggtgccccctcctggtcctgtcctcaccaccccttccccacctcctgggaaaaaaaaaaaaaaaaaaaaaaaagctggtataaagcagagagcctgagggctaaatttaactgtccgagtcggaatccatctctgagtcacccaagaagctgccctggcctcccgtccccttcccaggcctcaacccctttctcccacccagccccaacccccagccctcaccccctagcccccagttctggagcttgtcgggagcaagggggtggttgctactgggtcactcagcctcaattggccctgtttcagcaatgggcaggttcttcttgaaattcatcacacctgtggcttcctctgtgctctacctttttattggggtgacagtgtgacagctgagattctccatgcattccccctactctagcactgaagggttctgaagggccctggaaggagggagcttggggggctggcttgtgaggggttaaggctgggaggcgggaggggggctggaccaaggggtggggagaaggggaggaggcctcggccggccgcagagagaagtggccagagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgtgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgcccaaagctctggactccacagtgtccgcggtttgcgttgtgggccggaggctccgcagcgggccaatccggaggcgtgtggaggcggccgaaggtctgggaggagctagcgggatgcgaagcggccgaatcagggttgggggaggaaaagccacggggcggggctttggcgtccggccaataggagggcgagcgggccacccggaggcaccgcccccgcccagctgtggcccagctgtgccaccgagcgtcgagaagagggggctgggctggcagcgcgcgcggccatcctccttccactgcgcctgcgcacgccacgcgcatccgctcctgggacgcaagctcgagaaaagttgctgcaaactttctagcccgttccccgcccctcctcccggccagacccgccccccctgcggagccgggaattccgaggggcggagcgcaggccgagatggggaatgtgggggcctgcagaggaccctggagacggaggcgtgcagaagctcagtctcggggcggaggcttcgcgcccttagtcctcctggacggcccgttaccttctgcgttgtcccgatggggaaactgaggccctgagccagaagcacacgctggggggaggcagaaagcgcggccagaggcggagggaaaacaaagggagaatcacagacagacgggagggggacggacacacacaaggggacagagacccgagtggagagctggatctcgccttcccggcgtggggcgcagggtcggccagaaagaagatcgagaagagcggggagtgggggcgaaaaggggggacaggtgggggaggaggctggggaaagcccgagggaggaagagagggagggaggaacttcccaaagttgcaaaacatggctaccttgccactgaagccagagacggccatctccgtgcctgagggaggcctcccggtggcccccagccctgctctcccagaggctcacgccctaggcaccctttctgcacagcagccaccccccgccgctgccaccacctccagcaccagcctgcccttctcccctgactcccctggcctcctgcccaacttcccggcgcccccaccagaggggctgatgttgtcacccgcggccgtgcctgtctggtcagcagggctggaactaagcgcaggaacagaggggctgctggaagcggaaaaggggctggggacacaggccccccacaccatgctgaggctgccagaccccgaccctgaggggctgctcctgggggccaccgcagggggtgaggttgacgaggggttggaagctgaggccaaggttctgacccagctccagtcggtgcctgtggaggagcccttggaactgtgacccagtgtggccccgtggcctctcccgacattggtgctgaagacgcagggacaggaatgggaggggggagccccagaaatgcggttgctgaagaccccagtcaccacatccttctgcctgggtggcctctccaagccctggtggtgctgggggttgtatccccggccacctcctgtccaggtctccatccccctttggatgggaggcctctctgttacagccctccccatgctgtgccctgccatatacgtgggggactcagggtcctgactcaggggccctgccccctccacttggtactagctgtaagcggaacaccctgccccagggccggacttccagcccccagagccctctccctgtcactccctgaaacactattaatagctctgccgatagctggtgttgtcacaactgcctggaatccgaaggtggaggacaggcagccccgcgcccctgagactggagaccctccccagtgtggcatttcctgccaggggcggggggtggggcagctgtggggagacgggggtcttccttcaccagctcccctcgactcaagcccttgtcctcattatccggcccagaccaaagattccctcatccctgggggcagccctgccgctgtgtctcctttgtatcctaaatctttatttttctaggacatgttatgcctccattttcaattaaaataaagttatcggattacaccacca

SEQ ID NO: 369553 - DNA, 8852 bp, Homo sapiens
cggctgcgggcggcagtccggcagtggcggggcccggggggcgcccaagatggcggcgggcggcgcggagggcggctcgggccccggcgccgccatgggggactgcgcggagattaagtcgcaattccgcacgcgcgagggtttctacaagctactcccgggcgacggcgccgctcgcaggtcgggtccggcttccgcccagactccggtgccgcctcagccaccgcagcccccgcccggccctgcctccgcctccggtcccggcgctgcaggccccgcgtcgtccccgccgcccgcaggccccggacccgggcccgccctgcccgccgtgcgcctcagcctcgtgcgcctcggggagccggacagcgccggggccggggagccgcccgccacgcccgcggggctgggctcggggggagaccgcgtctgcttcaacttgggccgtgagctctatttctacccaggctgctgtcgtcgtgggagccaacggtccattgacctcaacaagccaattgacaagcggatctacaagggcacccagcccacctgccacgatttcaaccagttcactgctgccaccgagaccatctcgctgctggtgggcttctcagcgggtcaagtgcagtacctggatctcatcaaaaaggacaccagcaagctgttcaatgaggagcggttgatcgacaagaccaaggtgacatatctgaagtggctgcctgagtcggagagcctgttcctggcatcacacgccagtggccacctgtacctgtacaacgtcagccacccctgcgcctcggccccgccccagtacagcctgctgaagcagggcgagggcttctctgtctatgctgccaagagcaaggcaccccgcaacccgctggccaagtgggcggtgggtgaggggcccctcaacgagttcgccttctcgcccgatggccggcacctggcctgtgtgagccaggatggctgcctgcgcgtcttccacttcgactccatgctcctgcgtgggctcatgaagagctactttgggggcctgctgtgtgtgtgctggagccctgacggccgctacgtggtgacgggtggcgaagatgacctggtcaccgtgtggtccttcaccgagggccgcgtggtggctcgaggccatggccacaagtcctgggtcaacgctgtggcctttgacccctacaccacaagggcagaggaggcggcgacagcagccggtgctgatggggagcggagcggcgaagaggaggaggaggagcccgaggctgcgggcacaggctcggccgggggcgccccgctctctccactgcccaaggctggctccattacttaccgctttggctcggcgggccaggacacgcagttctgcctgtgggacctcactgaagacgtgctctacccgcacccgcccctggcccgcacccgcaccctccctggcacacctggcaccacgccaccggccgccagcagctcgaggggtggcgagcctggcccaggccccctgcctcgctcgctgtcccgctccaacagtctcccgcacccagctggcgggggcaaggcgggcggcccgggtgtggcggcagagcctggcacaccattcagcattggccgcttcgccacgctcacactgcaggagcggcgggaccggggggcagagaaggagcacaagcgctaccacagcctgggcaacatcagccggggtggcagtggcggcagtggcagtggtggggagaagcccagcggccctgttccccgcagccgcctggaccccgccaaggtgctgggcactgcgctgtgcccgcgcatccacgaggtgcccctgctggagccccttgtgtgcaagaagatcgcccaggagcggctcacagtcctcctgttcctggaggactgcatcatcactgcctgccaggagggcctcatctgcacctgggcccggccgggcaaggcgttcacagacgaggagaccgaggcccagacaggggaaggaagttggcccaggtcacccagcaagtcagtggtagagggcatctcctcccaaccaggcaactccccgagtggcacagtggtgtgaagccatggatatcgggcccccccaaccccatgcccccagcctcctagccataaccctccctgctgacctcacagatcaacgtattaacaagactaaccatgatggatggactgctccagtccccccacctgcacaaaatttgggggccccccagactggcccggacacgggcgatgtaatagcccttgtggcctcagccttgtcccccacccactgccaagtacaatgacctcttcctctgaaacatcagtgttaccctcatccctgtccccagcatgtgactggtcactcctggggagagactccccgcccctgccacaagagccccaggtctgcagtgtgcccctcagttgagtgggcagggccgggggtggtccagccctcgcccggcccccaccccagctgcccttgctattgtctgtgcttttgaagagtgttaaattatggaagcccctcaggttcctccctgtcccgcaggacctcttatttatactaaagttccctgttttctcagcgggtctgtccccttcggaggagatgatgtagaggacctgtgtgtgtactctgtggttctaggcagtccgctttccccagaggaggagtgcaggcctgctcccagcccagcgcctcccaccccttttcatagcaggaaaagccggagcccagggagggaacggacctgcgagtcacacaactggtgacccacaccagcggctggagcaggaccctcttggggagaagagcatcctgcccgcagccagggcccctcatcaaagtcctcggtgttttttaaattatcagaactgcccaggaccacgtttcccaggccctgcccagctgggactcctcggtccttgcctcctagtttctcaggcctggccctctcaaggcccaggcaccccaggccggttggaggccccgacttccactctggagaaccgtccaccctggaaagaagagctcagattcctcttggctctcggagccgcagggagtgtgtcttcccgcgccaccctccaccccccgaaatgtttctgtttctaatcccagcctgggcaggaatgtggctccccggccaggggccaaggagctattttggggtctcgtttgcccagggagggcttggctccaccactttcctcccccagcctttgggcagcaggtcacccctgttcaggctctgagggtgccccctcctggtcctgtcctcaccaccccttccccacctcctgggaaaaaaaaaaaaaaaaaaaaaaaagctggtataaagcagagagcctgagggctaaatttaactgtccgagtcggaatccatctctgagtcacccaagaagctgccctggcctcccgtccccttcccaggcctcaacccctttctcccacccagccccaacccccagccctcaccccctagcccccagttctggagcttgtcgggagcaagggggtggttgctactgggtcactcagcctcaattggccctgtttcagcaatgggcaggttcttcttgaaattcatcacacctgtggcttcctctgtgctctacctttttattggggtgacagtgtgacagctgagattctccatgcattccccctactctagcactgaagggttctgaagggccctggaaggagggagcttggggggctggcttgtgaggggttaaggctgggaggcgggaggggggctggaccaaggggtggggagaaggggaggaggcctcggccggccgcagagagaagtggccagagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgtgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgcccaaagctctggactccacagtgtccgcggtttgcgttgtgggccggaggctccgcagcgggccaatccggaggcgtgtggaggcggccgaaggtctgggaggagctagcgggatgcgaagcggccgaatcagggttgggggaggaaaagccacggggcggggctttggcgtccggccaataggagggcgagcgggccacccggaggcaccgcccccgcccagctgtggcccagctgtgccaccgagcgtcgagaagagggggctgggctggcagcgcgcgcggccatcctccttccactgcgcctgcgcacgccacgcgcatccgctcctgggacgcaagctcgagaaaagttgctgcaaactttctagcccgttccccgcccctcctcccggccagacccgccccccctgcggagccgggaattccgaggggcggagcgcaggccgagatggggaatgtgggggcctgcagaggaccctggagacggaggcgtgcagaagctcagtctcggggcggaggcttcgcgcccttagtcctcctggacggcccgttaccttctgcgttgtcccgatggggaaactgaggccctgagccagaagcacacgctggggggaggcagaaagcgcggccagaggcggagggaaaacaaagggagaatcacagacagacgggagggggacggacacacacaaggggacagagacccgagtggagagctggatctcgccttcccggcgtggggcgcagggtcggccagaaagaagatcgagaagagcggggagtgggggcgaaaaggggggacaggtgggggaggaggctggggaaagcccgagggaggaagagagggagggaggaacttcccaaagttgcaaaacatggctaccttgcctgcggagccgagcgcggggccggcggctgggggggaggcggtggcggcggcggcggcgaccgaagaggaggaggaggaagcgcgccagctcttgcagactttgcaggcggccgagggtgaggcggcggcggcggccggggccggggcgggcgcagcggctgcgggagctgagggcccgggatccccgggcgtccccgggtcgccccccgaggccgcttccgaaccgcccacgggcctccgcttctcgcccgagcaggtggcgtgcgtctgcgaggcgctgctccaggcgggccacgccggccgcttgagccgcttcctgggcgcactgcccccggccgagcgcctacgtggcagcgacccggtgttgcgcgcgcgggccctggtggccttccagcggggcgagtacgccgagctctaccggctactcgagagccgccccttccccgccgcccaccacgccttcctgcaggacctctacctgcgcgcgcgctaccatgaggccgagcgggcccgcggccgcgcgcttggcgcagtggacaagtatcgactgcgcaagaagttcccgctgcccaagaccatctgggacggcgaggagacagtctactgcttcaaggagcgctcccgcgcagcgctcaaggcctgctaccgcggcaaccgctaccccacgccggacgagaagcgccgcctggccacactcaccggcctgtcgctcacgcaggtcagcaactggttcaagaaccggcgacagcgcgaccggaccggggccggaggcggcgcgccctgcaagagcgagtctgatgggaatcccacgactgaggacgagtccagccgaagtcctgaggacctggagagaggggcggccccagtgtccgccgaggccgctgcccagggctccatattcctggcagggaccggccctcccgcgccttgcccggcttcctcctccatcctggtgaacgggagcttcctggcagccagcggctccccagcagtgctcctcaacgggggccccgtcatcatcaacggcctggccctgggcgaggcctccagcctgggcccgctgctgctcactgggggcgggggtgcccctccaccgcagcccagccctcagggggccagcgagaccaagacctctctggtcctggaccctcagacaggggaggtgcggctggaggaggctcagtcggaggcccctgagaccaaaggggcccaggtggctgctccgggaccagcccttggagaggaggtcctggggcccctggcccaagtggtgcctggccccccgacggctgccacctttcctctgcccccggggccagtgcctgctgtggctgccccacaagtggtaccgctctccccacccccggggtatccca

SEQ ID NO: 369554 - DNA, 8388 bp, Homo sapiens
cggctgcgggcggcagtccggcagtggcggggcccggggggcgcccaagatggcggcgggcggcgcggagggcggctcgggccccggcgccgccatgggggactgcgcggagattaagtcgcaattccgcacgcgcgagggtttctacaagctactcccgggcgacggcgccgctcgcaggtcgggtccggcttccgcccagactccggtgccgcctcagccaccgcagcccccgcccggccctgcctccgcctccggtcccggcgctgcaggccccgcgtcgtccccgccgcccgcaggccccggacccgggcccgccctgcccgccgtgcgcctcagcctcgtgcgcctcggggagccggacagcgccggggccggggagccgcccgccacgcccgcggggctgggctcggggggagaccgcgtctgcttcaacttgggccgtgagctctatttctacccaggctgctgtcgtcgtgggagccaacggtccattgacctcaacaagccaattgacaagcggatctacaagggcacccagcccacctgccacgatttcaaccagttcactgctgccaccgagaccatctcgctgctggtgggcttctcagcgggtcaagtgcagtacctggatctcatcaaaaaggacaccagcaagctgttcaatgaggagcggttgatcgacaagaccaaggtgacatatctgaagtggctgcctgagtcggagagcctgttcctggcatcacacgccagtggccacctgtacctgtacaacgtcagccacccctgcgcctcggccccgccccagtacagcctgctgaagcagggcgagggcttctctgtctatgctgccaagagcaaggcaccccgcaacccgctggccaagtgggcggtgggtgaggggcccctcaacgagttcgccttctcgcccgatggccggcacctggcctgtgtgagccaggatggctgcctgcgcgtcttccacttcgactccatgctcctgcgtgggctcatgaagagctactttgggggcctgctgtgtgtgtgctggagccctgacggccgctacgtggtgacgggtggcgaagatgacctggtcaccgtgtggtccttcaccgagggccgcgtggtggctcgaggccatggccacaagtcctgggtcaacgctgtggcctttgacccctacaccacaagggcagaggaggcggcgacagcagccggtgctgatggggagcggagcggcgaagaggaggaggaggagcccgaggctgcgggcacaggctcggccgggggcgccccgctctctccactgcccaaggctggctccattacttaccgctttggctcggcgggccaggacacgcagttctgcctgtgggacctcactgaagacgtgctctacccgcacccgcccctggcccgcacccgcaccctccctggcacacctggcaccacgccaccggccgccagcagctcgaggggtggcgagcctggcccaggccccctgcctcgctcgctgtcccgctccaacagtctcccgcacccagctggcgggggcaaggcgggcggcccgggtgtggcggcagagcctggcacaccattcagcattggccgcttcgccacgctcacactgcaggagcggcgggaccggggggcagagaaggagcacaagcgctaccacagcctgggcaacatcagccggggtggcagtggcggcagtggcagtggtggggagaagcccagcggccctgttccccgcagccgcctggaccccgccaaggtgctgggcactgcgctgtgcccgcgcatccacgaggtgcccctgctggagccccttgtgtgcaagaagatcgcccaggagcggctcacagtcctcctgttcctggaggactgcatcatcactgcctgccaggagggcctcatctgcacctgggcccggccgggcaaggcgttcacagacgaggagaccgaggcccagacaggggaaggaagttggcccaggtcacccagcaagtcagtggtagagggcatctcctcccaaccaggcaactccccgagtggcacagtggtgtgaagccatggatatcgggcccccccaaccccatgcccccagcctcctagccataaccctccctgctgacctcacagatcaacgtattaacaagactaaccatgatggatggactgctccagtccccccacctgcacaaaatttgggggccccccagactggcccggacacgggcgatgtaatagcccttgtggcctcagccttgtcccccacccactgccaagtacaatgacctcttcctctgaaacatcagtgttaccctcatccctgtccccagcatgtgactggtcactcctggggagagactccccgcccctgccacaagagccccaggtctgcagtgtgcccctcagttgagtgggcagggccgggggtggtccagccctcgcccggcccccaccccagctgcccttgctattgtctgtgcttttgaagagtgttaaattatggaagcccctcaggttcctccctgtcccgcaggacctcttatttatactaaagttccctgttttctcagcgggtctgtccccttcggaggagatgatgtagaggacctgtgtgtgtactctgtggttctaggcagtccgctttccccagaggaggagtgcaggcctgctcccagcccagcgcctcccaccccttttcatagcaggaaaagccggagcccagggagggaacggacctgcgagtcacacaactggtgacccacaccagcggctggagcaggaccctcttggggagaagagcatcctgcccgcagccagggcccctcatcaaagtcctcggtgttttttaaattatcagaactgcccaggaccacgtttcccaggccctgcccagctgggactcctcggtccttgcctcctagtttctcaggcctggccctctcaaggcccaggcaccccaggccggttggaggccccgacttccactctggagaaccgtccaccctggaaagaagagctcagattcctcttggctctcggagccgcagggagtgtgtcttcccgcgccaccctccaccccccgaaatgtttctgtttctaatcccagcctgggcaggaatgtggctccccggccaggggccaaggagctattttggggtctcgtttgcccagggagggcttggctccaccactttcctcccccagcctttgggcagcaggtcacccctgttcaggctctgagggtgccccctcctggtcctgtcctcaccaccccttccccacctcctgggaaaaaaaaaaaaaaaaaaaaaaaagctggtataaagcagagagcctgagggctaaatttaactgtccgagtcggaatccatctctgagtcacccaagaagctgccctggcctcccgtccccttcccaggcctcaacccctttctcccacccagccccaacccccagccctcaccccctagcccccagttctggagcttgtcgggagcaagggggtggttgctactgggtcactcagcctcaattggccctgtttcagcaatgggcaggttcttcttgaaattcatcacacctgtggcttcctctgtgctctacctttttattggggtgacagtgtgacagctgagattctccatgcattccccctactctagcactgaagggttctgaagggccctggaaggagggagcttggggggctggcttgtgaggggttaaggctgggaggcgggaggggggctggaccaaggggtggggagaaggggaggaggcctcggccggccgcagagagaagtggccagagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgtgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgcccaaagctctggactccacagtgtccgcggtttgcgttgtgggccggaggctccgcagcgggccaatccggaggcgtgtggaggcggccgaaggtctgggaggagctagcgggatgcgaagcggccgaatcagggttgggggaggaaaagccacggggcggggctttggcgtccggccaataggagggcgagcgggccacccggaggcaccgcccccgcccagctgtggcccagctgtgccaccgagcgtcgagaagagggggctgggctggcagcgcgcgcggccatcctccttccactgcgcctgcgcacgccacgcgcatccgctcctgggacgcaagctcgagaaaagttgctgcaaactttctagcccgttccccgcccctcctcccggccagacccgccccccctgcggagccgggaattccgaggggcggagcgcaggccgagatggggaatgtgggggcctgcagaggaccctggagacggaggcgtgcagaagctcagtctcggggcggaggcttcgcgcccttagtcctcctggacggcccgttaccttctgcgttgtcccgatggggaaactgaggccctgagccagaagcacacgctggggggaggcagaaagcgcggccagaggcggagggaaaacaaagggagaatcacagacagacgggagggggacggacacacacaaggggacagagacccgagtggagagctggatctcgccttcccggcgtggggcgcagggtcggccagaaagaagatcgagaagagcggggagtgggggcgaaaaggggggacaggtgggggaggaggctggggaaagcccgagggaggaagagagggagggaggaacttcccaaagttgcaaaacatggctaccttgcctgcggagccgagcgcggggccggcggctgggggggaggcggtggcggcggcggcggcgaccgaagaggaggaggaggaagcgcgccagctcttgcagactttgcaggcggccgagggtgaggcggcggcggcggccggggccggggcgggcgcagcggctgcgggagctgagggcccgggatccccgggcgtccccgggtcgccccccgaggccgcttccgaaccgcccacgggcctccgcttctcgcccgagcaggtggcgtgcgtctgcgaggcgctgctccaggcgggccacgccggccgcttgagccgcttcctgggcgcactgcccccggccgagcgcctacgtggcagcgacccggtgttgcgcgcgcgggccctggtggccttccagcggggcgagtacgccgagctctaccggctactcgagagccgccccttccccgccgcccaccacgccttcctgcaggacctctacctgcgcgcgcgctaccatgaggccgagcgggcccgcggccgcgcgcttggcgcagtggacaagtatcgactgcgcaagaagttcccgctgcccaagaccatctgggacggcgaggagacagtctactgcttcaaggagcgctcccgcgcagcgctcaaggcctgctaccgcggcaaccgctaccccacgccggacgagaagcgccgcctggccacactcaccggcctgtcgctcacgcaggtcagcaactggttcaagaaccggcgacagcgcgaccggaccggggccggaggcggcgcgccctgcaagaggaaacttcctcctggccaaccctgtgtctggcagccccatcgtgacgggtgtggccctgcagcagggcaagatcatcctcaccgccaccttccccaccagcatgctcgtctcccaggtcctgc

SEQ ID NO: 369555 - DNA, 8608 bp, Homo sapiens
cggctgcgggcggcagtccggcagtggcggggcccggggggcgcccaagatggcggcgggcggcgcggagggcggctcgggccccggcgccgccatgggggactgcgcggagattaagtcgcaattccgcacgcgcgagggtttctacaagctactcccgggcgacggcgccgctcgcaggtcgggtccggcttccgcccagactccggtgccgcctcagccaccgcagcccccgcccggccctgcctccgcctccggtcccggcgctgcaggccccgcgtcgtccccgccgcccgcaggccccggacccgggcccgccctgcccgccgtgcgcctcagcctcgtgcgcctcggggagccggacagcgccggggccggggagccgcccgccacgcccgcggggctgggctcggggggagaccgcgtctgcttcaacttgggccgtgagctctatttctacccaggctgctgtcgtcgtgggagccaacggtccattgacctcaacaagccaattgacaagcggatctacaagggcacccagcccacctgccacgatttcaaccagttcactgctgccaccgagaccatctcgctgctggtgggcttctcagcgggtcaagtgcagtacctggatctcatcaaaaaggacaccagcaagctgttcaatgaggagcggttgatcgacaagaccaaggtgacatatctgaagtggctgcctgagtcggagagcctgttcctggcatcacacgccagtggccacctgtacctgtacaacgtcagccacccctgcgcctcggccccgccccagtacagcctgctgaagcagggcgagggcttctctgtctatgctgccaagagcaaggcaccccgcaacccgctggccaagtgggcggtgggtgaggggcccctcaacgagttcgccttctcgcccgatggccggcacctggcctgtgtgagccaggatggctgcctgcgcgtcttccacttcgactccatgctcctgcgtgggctcatgaagagctactttgggggcctgctgtgtgtgtgctggagccctgacggccgctacgtggtgacgggtggcgaagatgacctggtcaccgtgtggtccttcaccgagggccgcgtggtggctcgaggccatggccacaagtcctgggtcaacgctgtggcctttgacccctacaccacaagggcagaggaggcggcgacagcagccggtgctgatggggagcggagcggcgaagaggaggaggaggagcccgaggctgcgggcacaggctcggccgggggcgccccgctctctccactgcccaaggctggctccattacttaccgctttggctcggcgggccaggacacgcagttctgcctgtgggacctcactgaagacgtgctctacccgcacccgcccctggcccgcacccgcaccctccctggcacacctggcaccacgccaccggccgccagcagctcgaggggtggcgagcctggcccaggccccctgcctcgctcgctgtcccgctccaacagtctcccgcacccagctggcgggggcaaggcgggcggcccgggtgtggcggcagagcctggcacaccattcagcattggccgcttcgccacgctcacactgcaggagcggcgggaccggggggcagagaaggagcacaagcgctaccacagcctgggcaacatcagccggggtggcagtggcggcagtggcagtggtggggagaagcccagcggccctgttccccgcagccgcctggaccccgccaaggtgctgggcactgcgctgtgcccgcgcatccacgaggtgcccctgctggagccccttgtgtgcaagaagatcgcccaggagcggctcacagtcctcctgttcctggaggactgcatcatcactgcctgccaggagggcctcatctgcacctgggcccggccgggcaaggcgttcacagacgaggagaccgaggcccagacaggggaaggaagttggcccaggtcacccagcaagtcagtggtagagggcatctcctcccaaccaggcaactccccgagtggcacagtggtgtgaagccatggatatcgggcccccccaaccccatgcccccagcctcctagccataaccctccctgctgacctcacagatcaacgtattaacaagactaaccatgatggatggactgctccagtccccccacctgcacaaaatttgggggccccccagactggcccggacacgggcgatgtaatagcccttgtggcctcagccttgtcccccacccactgccaagtacaatgacctcttcctctgaaacatcagtgttaccctcatccctgtccccagcatgtgactggtcactcctggggagagactccccgcccctgccacaagagccccaggtctgcagtgtgcccctcagttgagtgggcagggccgggggtggtccagccctcgcccggcccccaccccagctgcccttgctattgtctgtgcttttgaagagtgttaaattatggaagcccctcaggttcctccctgtcccgcaggacctcttatttatactaaagttccctgttttctcagcgggtctgtccccttcggaggagatgatgtagaggacctgtgtgtgtactctgtggttctaggcagtccgctttccccagaggaggagtgcaggcctgctcccagcccagcgcctcccaccccttttcatagcaggaaaagccggagcccagggagggaacggacctgcgagtcacacaactggtgacccacaccagcggctggagcaggaccctcttggggagaagagcatcctgcccgcagccagggcccctcatcaaagtcctcggtgttttttaaattatcagaactgcccaggaccacgtttcccaggccctgcccagctgggactcctcggtccttgcctcctagtttctcaggcctggccctctcaaggcccaggcaccccaggccggttggaggccccgacttccactctggagaaccgtccaccctggaaagaagagctcagattcctcttggctctcggagccgcagggagtgtgtcttcccgcgccaccctccaccccccgaaatgtttctgtttctaatcccagcctgggcaggaatgtggctccccggccaggggccaaggagctattttggggtctcgtttgcccagggagggcttggctccaccactttcctcccccagcctttgggcagcaggtcacccctgttcaggctctgagggtgccccctcctggtcctgtcctcaccaccccttccccacctcctgggaaaaaaaaaaaaaaaaaaaaaaaagctggtataaagcagagagcctgagggctaaatttaactgtccgagtcggaatccatctctgagtcacccaagaagctgccctggcctcccgtccccttcccaggcctcaacccctttctcccacccagccccaacccccagccctcaccccctagcccccagttctggagcttgtcgggagcaagggggtggttgctactgggtcactcagcctcaattggccctgtttcagcaatgggcaggttcttcttgaaattcatcacacctgtggcttcctctgtgctctacctttttattggggtgacagtgtgacagctgagattctccatgcattccccctactctagcactgaagggttctgaagggccctggaaggagggagcttggggggctggcttgtgaggggttaaggctgggaggcgggaggggggctggaccaaggggtggggagaaggggaggaggcctcggccggccgcagagagaagtggccagagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgtgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgcccaaagctctggactccacagtgtccgcggtttgcgttgtgggccggaggctccgcagcgggccaatccggaggcgtgtggaggcggccgaaggtctgggaggagctagcgggatgcgaagcggccgaatcagggttgggggaggaaaagccacggggcggggctttggcgtccggccaataggagggcgagcgggccacccggaggcaccgcccccgcccagctgtggcccagctgtgccaccgagcgtcgagaagagggggctgggctggcagcgcgcgcggccatcctccttccactgcgcctgcgcacgccacgcgcatccgctcctgggacgcaagctcgagaaaagttgctgcaaactttctagcccgttccccgcccctcctcccggccagacccgccccccctgcggagccgggaattccgaggggcggagcgcaggccgagatggggaatgtgggggcctgcagaggaccctggagacggaggcgtgcagaagctcagtctcggggcggaggcttcgcgcccttagtcctcctggacggcccgttaccttctgcgttgtcccgatggggaaactgaggccctgagccagaagcacacgctggggggaggcagaaagcgcggccagaggcggagggaaaacaaagggagaatcacagacagacgggagggggacggacacacacaaggggacagagacccgagtggagagctggatctcgccttcccggcgtggggcgcagggtcggccagaaagaagatcgagaagagcggggagtgggggcgaaaaggggggacaggtgggggaggaggctggggaaagcccgagggaggaagagagggagggaggaacttcccaaagttgcaaaacatggctaccttgccactgaagccagagacggccatctccgtgcctgagggaggcctcccggtggcccccagccctgctctcccagaggctcacgccctaggcaccctttctgcacagcagccaccccccgccgctgccaccacctccagcaccagcctgcccttctcccctgactcccctggcctcctgcccaacttcccggcgcccccaccagaggggctgatgttgtcacccgcggccgtgcctgtctggtcagcagggctggaactaagcgcaggaacagaggggctgctggaagcggaaaaggggctggggacacaggccccccacaccatgctgaggctgccagaccccgaccctgaggggctgctcctgggggccaccgcagggggtgaggttgacgaggggttggaagctgaggccaaggttctgacccagctccagtcggtgcctgtggaggagcccttggaactgtgacccagtgtggccccgtggcctctcccgacattggtgctgaagacgcagggacaggaatgggaggggggagccccagaaatgcggttgctgaagaccccagtcaccacatccttctgcctgggtggcctctccaagccctggtggtgctgggggttgtatccccggccacctcctgtccaggtctccatccccctttggatgggaggcctctctgttacagccctccccatgctgtgccctgccatatacgtgggggactcagggtcctgactcaggggccctgccccctccacttggtactagctgtaagcggaacaccctgccccagggccggacttccagcccccagagccctctccctgtcactccctgaaacactattaatagctctgccgatagctggtgttgtcacaactgcctggaatccgaaggtggaggacaggcagccccgcgcccctgagactggagaccctccccagtgtggcatttcctgccaggggcggggggtggggcagctgtggggagacgggggcctgcaccggattttaacactttgcccgggggttttcattacaatggccgggctttaacaacttatggtgtgacacccctgacatacccgactttatggggttgaggaaataccatttggcaggtggggtaataacg

SEQ ID NO: 369556 - DNA, 9274 bp, Homo sapiens
  misc_feature (6047)..(6047): n is a, c, g, or t
  misc_feature (6090)..(6090): n is a, c, g, or t
  misc_feature (6113)..(6113): n is a, c, g, or t
cggctgcgggcggcagtccggcagtggcggggcccggggggcgcccaagatggcggcgggcggcgcggagggcggctcgggccccggcgccgccatgggggactgcgcggagattaagtcgcaattccgcacgcgcgagggtttctacaagctactcccgggcgacggcgccgctcgcaggtcgggtccggcttccgcccagactccggtgccgcctcagccaccgcagcccccgcccggccctgcctccgcctccggtcccggcgctgcaggccccgcgtcgtccccgccgcccgcaggccccggacccgggcccgccctgcccgccgtgcgcctcagcctcgtgcgcctcggggagccggacagcgccggggccggggagccgcccgccacgcccgcggggctgggctcggggggagaccgcgtctgcttcaacttgggccgtgagctctatttctacccaggctgctgtcgtcgtgggagccaacggtccattgacctcaacaagccaattgacaagcggatctacaagggcacccagcccacctgccacgatttcaaccagttcactgctgccaccgagaccatctcgctgctggtgggcttctcagcgggtcaagtgcagtacctggatctcatcaaaaaggacaccagcaagctgttcaatgaggagcggttgatcgacaagaccaaggtgacatatctgaagtggctgcctgagtcggagagcctgttcctggcatcacacgccagtggccacctgtacctgtacaacgtcagccacccctgcgcctcggccccgccccagtacagcctgctgaagcagggcgagggcttctctgtctatgctgccaagagcaaggcaccccgcaacccgctggccaagtgggcggtgggtgaggggcccctcaacgagttcgccttctcgcccgatggccggcacctggcctgtgtgagccaggatggctgcctgcgcgtcttccacttcgactccatgctcctgcgtgggctcatgaagagctactttgggggcctgctgtgtgtgtgctggagccctgacggccgctacgtggtgacgggtggcgaagatgacctggtcaccgtgtggtccttcaccgagggccgcgtggtggctcgaggccatggccacaagtcctgggtcaacgctgtggcctttgacccctacaccacaagggcagaggaggcggcgacagcagccggtgctgatggggagcggagcggcgaagaggaggaggaggagcccgaggctgcgggcacaggctcggccgggggcgccccgctctctccactgcccaaggctggctccattacttaccgctttggctcggcgggccaggacacgcagttctgcctgtgggacctcactgaagacgtgctctacccgcacccgcccctggcccgcacccgcaccctccctggcacacctggcaccacgccaccggccgccagcagctcgaggggtggcgagcctggcccaggccccctgcctcgctcgctgtcccgctccaacagtctcccgcacccagctggcgggggcaaggcgggcggcccgggtgtggcggcagagcctggcacaccattcagcattggccgcttcgccacgctcacactgcaggagcggcgggaccggggggcagagaaggagcacaagcgctaccacagcctgggcaacatcagccggggtggcagtggcggcagtggcagtggtggggagaagcccagcggccctgttccccgcagccgcctggaccccgccaaggtgctgggcactgcgctgtgcccgcgcatccacgaggtgcccctgctggagccccttgtgtgcaagaagatcgcccaggagcggctcacagtcctcctgttcctggaggactgcatcatcactgcctgccaggagggcctcatctgcacctgggcccggccgggcaaggcgttcacagacgaggagaccgaggcccagacaggggaaggaagttggcccaggtcacccagcaagtcagtggtagagggcatctcctcccaaccaggcaactccccgagtggcacagtggtgtgaagccatggatatcgggcccccccaaccccatgcccccagcctcctagccataaccctccctgctgacctcacagatcaacgtattaacaagactaaccatgatggatggactgctccagtccccccacctgcacaaaatttgggggccccccagactggcccggacacgggcgatgtaatagcccttgtggcctcagccttgtcccccacccactgccaagtacaatgacctcttcctctgaaacatcagtgttaccctcatccctgtccccagcatgtgactggtcactcctggggagagactccccgcccctgccacaagagccccaggtctgcagtgtgcccctcagttgagtgggcagggccgggggtggtccagccctcgcccggcccccaccccagctgcccttgctattgtctgtgcttttgaagagtgttaaattatggaagcccctcaggttcctccctgtcccgcaggacctcttatttatactaaagttccctgttttctcagcgggtctgtccccttcggaggagatgatgtagaggacctgtgtgtgtactctgtggttctaggcagtccgctttccccagaggaggagtgcaggcctgctcccagcccagcgcctcccaccccttttcatagcaggaaaagccggagcccagggagggaacggacctgcgagtcacacaactggtgacccacaccagcggctggagcaggaccctcttggggagaagagcatcctgcccgcagccagggcccctcatcaaagtcctcggtgttttttaaattatcagaactgcccaggaccacgtttcccaggccctgcccagctgggactcctcggtccttgcctcctagtttctcaggcctggccctctcaaggcccaggcaccccaggccggttggaggccccgacttccactctggagaaccgtccaccctggaaagaagagctcagattcctcttggctctcggagccgcagggagtgtgtcttcccgcgccaccctccaccccccgaaatgtttctgtttctaatcccagcctgggcaggaatgtggctccccggccaggggccaaggagctattttggggtctcgtttgcccagggagggcttggctccaccactttcctcccccagcctttgggcagcaggtcacccctgttcaggctctgagggtgccccctcctggtcctgtcctcaccaccccttccccacctcctgggaaaaaaaaaaaaaaaaaaaaaaaagctggtataaagcagagagcctgagggctaaatttaactgtccgagtcggaatccatctctgagtcacccaagaagctgccctggcctcccgtccccttcccaggcctcaacccctttctcccacccagccccaacccccagccctcaccccctagcccccagttctggagcttgtcgggagcaagggggtggttgctactgggtcactcagcctcaattggccctgtttcagcaatgggcaggttcttcttgaaattcatcacacctgtggcttcctctgtgctctacctttttattggggtgacagtgtgacagctgagattctccatgcattccccctactctagcactgaagggttctgaagggccctggaaggagggagcttggggggctggcttgtgaggggttaaggctgggaggcgggaggggggctggaccaaggggtggggagaaggggaggaggcctcggccggccgcagagagaagtggccagagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatgtaagacccctctctttcccctgcctcagacctgctgcccattctgcagatcccctccctggctcctggtctccccgtccagatatagggctcaccctacgtctttgcgactttagagggcagaagccctttattcagccccagatctccctccgttcaggcctcaccagattccctccgggatctccctagataacctccccaacctcgattcccctcgctgtctctcgccccaccgctgagggctgggctgggctccgatcgggtcacctgtcccttctctctccagctagatggccccccggccgtggctgtgggccagtgcccgctggtggggccaggccccatgcaccgccgccacctgctgctccctgccagggtacgtccggctgcccacgcccccctccgccgtcgcgccccgcgctccacccgccccntgccacccgcttagctgcgcatttgcggggctgggcccacggnaggagggcggatcttcgggcagncaatcaacacaggccgctaggaagcagccaatgacgagttcggacgggattcgaggcgtgcgagtggactaacaacagctgtaggctgttggggcgggggcggggcgcagggaagagtgcgggcccacctatgggcgtaggcggggcgagtcccaggagccaatcagaggcccatgccgggtgttgacctcgccctctccccgcaggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgtgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgcccaaagctctggactccacagtgtccgcggtttgcgttgtgggccggaggctccgcagcgggccaatccggaggcgtgtggaggcggccgaaggtctgggaggagctagcgggatgcgaagcggccgaatcagggttgggggaggaaaagccacggggcggggctttggcgtccggccaataggagggcgagcgggccacccggaggcaccgcccccgcccagctgtggcccagctgtgccaccgagcgtcgagaagagggggctgggctggcagcgcgcgcggccatcctccttccactgcgcctgcgcacgccacgcgcatccgctcctgggacgcaagctcgagaaaagttgctgcaaactttctagcccgttccccgcccctcctcccggccagacccgccccccctgcggagccgggaattccgaggggcggagcgcaggccgagatggggaatgtgggggcctgcagaggaccctggagacggaggcgtgcagaagctcagtctcggggcggaggcttcgcgcccttagtcctcctggacggcccgttaccttctgcgttgtcccgatggggaaactgaggccctgagccagaagcacacgctggggggaggcagaaagcgcggccagaggcggagggaaaacaaagggagaatcacagacagacgggagggggacggacacacacaaggggacagagacccgagtggagagctggatctcgccttcccggcgtggggcgcagggtcggccagaaagaagatcgagaagagcggggagtgggggcgaaaaggggggacaggtgggggaggaggctggggaaagcccgagggaggaagagagggagggaggaacttcccaaagttgcaaaacatggctaccttgccactgaagccagagacggccatctccgtgcctgagggaggcctcccggtggcccccagccctgctctcccagaggctcacgccctaggcaccctttctgcacagcagccaccccccgccgctgccaccacctccagcaccagcctgcccttctcccctgactcccctggcctcctgcccaacttcccggcgcccccaccagaggggctgatgttgtcacccgcggccgtgcctgtctggtcagcagggctggaactaagcgcaggaacagaggggctgctggaagcggaaaaggggctggggacacaggccccccacaccatgctgaggctgccagaccccgaccctgaggggctgctcctgggggccaccgcagggggtgaggttgacgaggggttggaagctgaggccaaggttctgacccagctccagtcggtgcctgtggaggagcccttggaactgtgacccagtgtggccccgtggcctctcccgacattggtgctgaagacgcagggacaggaatgggaggggggagccccagaaatgcggttgctgaagaccccagtcaccacatccttctgcctgggtggcctctccaagccctggtggtgctgggggttgtatccccggccacctcctgtccaggtctccatccccctttggatgggaggcctctctgttacagccctccccatgctgtgccctgccatatacgtgggggactcagggtcctgactcaggggccctgccccctccacttggtactagctgtaagcggaacaccctgccccagggccggacttccagcccccagagccctctccctgtcactccctgaaacactattaatagctctgccgatagctggtgttgtcacaactgcctggaatccgaaggtggaggacaggcagccccgcgcccctgagactggagaccctccccagtgtggcatttcctgccaggggcggggggtggggcagctgtggggagacgggggtcttccttcaccagctcccctcgactcaagcccttgtcctcattatccggcccagaccaaagattccctcatccctgggggcagccctgccgctgtgtctcctttgtatcctaaatctttatttttctaggacatgttatgcctccattttcaattaaaataaagttatcggattacaccacca

SEQ ID NO: 369557 - DNA, 9333 bp, Homo sapiens
  misc_feature (6106)..(6106): n is a, c, g, or t
  misc_feature (6149)..(6149): n is a, c, g, or t
  misc_feature (6172)..(6172): n is a, c, g, or t
cggctgcgggcggcagtccggcagtggcggggcccggggggcgcccaagatggcggcgggcggcgcggagggcggctcgggccccggcgccgccatgggggactgcgcggagattaagtcgcaattccgcacgcgcgagggtttctacaagctactcccgggcgacggcgccgctcgcaggtcgggtccggcttccgcccagactccggtgccgcctcagccaccgcagcccccgcccggccctgcctccgcctccggtcccggcgctgcaggccccgcgtcgtccccgccgcccgcaggccccggacccgggcccgccctgcccgccgtgcgcctcagcctcgtgcgcctcggggagccggacagcgccggggccggggagccgcccgccacgcccgcggggctgggctcggggggagaccgcgtctgcttcaacttgggccgtgagctctatttctacccaggctgctgtcgtcgtgggagccaacggtccattgacctcaacaagccaattgacaagcggatctacaagggcacccagcccacctgccacgatttcaaccagttcactgctgccaccgagaccatctcgctgctggtgggcttctcagcgggtcaagtgcagtacctggatctcatcaaaaaggacaccagcaagctgttcaatgaggagcggttgatcgacaagaccaaggtgacatatctgaagtggctgcctgagtcggagagcctgttcctggcatcacacgccagtggccacctgtacctgtacaacgtcagccacccctgcgcctcggccccgccccagtacagcctgctgaagcagggcgagggcttctctgtctatgctgccaagagcaaggcaccccgcaacccgctggccaagtgggcggtgggtgaggggcccctcaacgagttcgccttctcgcccgatggccggcacctggcctgtgtgagccaggatggctgcctgcgcgtcttccacttcgactccatgctcctgcgtgggctcatgaagagctactttgggggcctgctgtgtgtgtgctggagccctgacggccgctacgtggtgacgggtggcgaagatgacctggtcaccgtgtggtccttcaccgagggccgcgtggtggctcgaggccatggccacaagtcctgggtcaacgctgtggcctttgacccctacaccacaagggcagaggaggcggcgacagcagccggtgctgatggggagcggagcggcgaagaggaggaggaggagcccgaggctgcgggcacaggctcggccgggggcgccccgctctctccactgcccaaggctggctccattacttaccgctttggctcggcgggccaggacacgcagttctgcctgtgggacctcactgaagacgtgctctacccgcacccgcccctggcccgcacccgcaccctccctggcacacctggcaccacgccaccggccgccagcagctcgaggggtggcgagcctggcccaggccccctgcctcgctcgctgtcccgctccaacagtctcccgcacccagctggcgggggcaaggcgggcggcccgggtgtggcggcagagcctggcacaccattcagcattggccgcttcgccacgctcacactgcaggagcggcgggaccggggggcagagaaggagcacaagcgctaccacagcctgggcaacatcagccggggtggcagtggcggcagtggcagtggtggggagaagcccagcggccctgttccccgcagccgcctggaccccgccaaggtgctgggcactgcgctgtgcccgcgcatccacgaggtgcccctgctggagccccttgtgtgcaagaagatcgcccaggagcggctcacagtcctcctgttcctggaggactgcatcatcactgcctgccaggagggcctcatctgcacctgggcccggccgggcaaggcgttcacagacgaggagaccgaggcccagacaggggaaggaagttggcccaggtcacccagcaagtcagtggtagagggcatctcctcccaaccaggcaactccccgagtggcacagtggtgtgaagccatggatatcgggcccccccaaccccatgcccccagcctcctagccataaccctccctgctgacctcacagatcaacgtattaacaagactaaccatgatggatggactgctccagtccccccacctgcacaaaatttgggggccccccagactggcccggacacgggcgatgtaatagcccttgtggcctcagccttgtcccccacccactgccaagtacaatgacctcttcctctgaaacatcagtgttaccctcatccctgtccccagcatgtgactggtcactcctggggagagactccccgcccctgccacaagagccccaggtctgcagtgtgcccctcagttgagtgggcagggccgggggtggtccagccctcgcccggcccccaccccagctgcccttgctattgtctgtgcttttgaagagtgttaaattatggaagcccctcaggttcctccctgtcccgcaggacctcttatttatactaaagttccctgttttctcagcgggtctgtccccttcggaggagatgatgtagaggacctgtgtgtgtactctgtggttctaggcagtccgctttccccagaggaggagtgcaggcctgctcccagcccagcgcctcccaccccttttcatagcaggaaaagccggagcccagggagggaacggacctgcgagtcacacaactggtgacccacaccagcggctggagcaggaccctcttggggagaagagcatcctgcccgcagccagggcccctcatcaaagtcctcggtgttttttaaattatcagaactgcccaggaccacgtttcccaggccctgcccagctgggactcctcggtccttgcctcctagtttctcaggcctggccctctcaaggcccaggcaccccaggccggttggaggccccgacttccactctggagaaccgtccaccctggaaagaagagctcagattcctcttggctctcggagccgcagggagtgtgtcttcccgcgccaccctccaccccccgaaatgtttctgtttctaatcccagcctgggcaggaatgtggctccccggccaggggccaaggagctattttggggtctcgtttgcccagggagggcttggctccaccactttcctcccccagcctttgggcagcaggtcacccctgttcaggctctgagggtgccccctcctggtcctgtcctcaccaccccttccccacctcctgggaaaaaaaaaaaaaaaaaaaaaaaagctggtataaagcagagagcctgagggctaaatttaactgtccgagtcggaatccatctctgagtcacccaagaagctgccctggcctcccgtccccttcccaggcctcaacccctttctcccacccagccccaacccccagccctcaccccctagcccccagttctggagcttgtcgggagcaagggggtggttgctactgggtcactcagcctcaattggccctgtttcagcaatgggcaggttcttcttgaaattcatcacacctgtggcttcctctgtgctctacctttttattggggtgacagtgtgacagctgagattctccatgcattccccctactctagcactgaagggttctgaagggccctggaaggagggagcttggggggctggcttgtgaggggttaaggctgggaggcgggaggggggctggaccaaggggtggggagaaggggaggaggcctcggccggccgcagagagaagtggccagagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggccccaaatccagggttttccaaagtgtggttcaagaaccacctgcatctgaatctagagcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatgtaagacccctctctttcccctgcctcagacctgctgcccattctgcagatcccctccctggctcctggtctccccgtccagatatagggctcaccctacgtctttgcgactttagagggcagaagccctttattcagccccagatctccctccgttcaggcctcaccagattccctccgggatctccctagataacctccccaacctcgattcccctcgctgtctctcgccccaccgctgagggctgggctgggctccgatcgggtcacctgtcccttctctctccagctagatggccccccggccgtggctgtgggccagtgcccgctggtggggccaggccccatgcaccgccgccacctgctgctccctgccagggtacgtccggctgcccacgcccccctccgccgtcgcgccccgcgctccacccgccccntgccacccgcttagctgcgcatttgcggggctgggcccacggnaggagggcggatcttcgggcagncaatcaacacaggccgctaggaagcagccaatgacgagttcggacgggattcgaggcgtgcgagtggactaacaacagctgtaggctgttggggcgggggcggggcgcagggaagagtgcgggcccacctatgggcgtaggcggggcgagtcccaggagccaatcagaggcccatgccgggtgttgacctcgccctctccccgcaggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgtgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgcccaaagctctggactccacagtgtccgcggtttgcgttgtgggccggaggctccgcagcgggccaatccggaggcgtgtggaggcggccgaaggtctgggaggagctagcgggatgcgaagcggccgaatcagggttgggggaggaaaagccacggggcggggctttggcgtccggccaataggagggcgagcgggccacccggaggcaccgcccccgcccagctgtggcccagctgtgccaccgagcgtcgagaagagggggctgggctggcagcgcgcgcggccatcctccttccactgcgcctgcgcacgccacgcgcatccgctcctgggacgcaagctcgagaaaagttgctgcaaactttctagcccgttccccgcccctcctcccggccagacccgccccccctgcggagccgggaattccgaggggcggagcgcaggccgagatggggaatgtgggggcctgcagaggaccctggagacggaggcgtgcagaagctcagtctcggggcggaggcttcgcgcccttagtcctcctggacggcccgttaccttctgcgttgtcccgatggggaaactgaggccctgagccagaagcacacgctggggggaggcagaaagcgcggccagaggcggagggaaaacaaagggagaatcacagacagacgggagggggacggacacacacaaggggacagagacccgagtggagagctggatctcgccttcccggcgtggggcgcagggtcggccagaaagaagatcgagaagagcggggagtgggggcgaaaaggggggacaggtgggggaggaggctggggaaagcccgagggaggaagagagggagggaggaacttcccaaagttgcaaaacatggctaccttgccactgaagccagagacggccatctccgtgcctgagggaggcctcccggtggcccccagccctgctctcccagaggctcacgccctaggcaccctttctgcacagcagccaccccccgccgctgccaccacctccagcaccagcctgcccttctcccctgactcccctggcctcctgcccaacttcccggcgcccccaccagaggggctgatgttgtcacccgcggccgtgcctgtctggtcagcagggctggaactaagcgcaggaacagaggggctgctggaagcggaaaaggggctggggacacaggccccccacaccatgctgaggctgccagaccccgaccctgaggggctgctcctgggggccaccgcagggggtgaggttgacgaggggttggaagctgaggccaaggttctgacccagctccagtcggtgcctgtggaggagcccttggaactgtgacccagtgtggccccgtggcctctcccgacattggtgctgaagacgcagggacaggaatgggaggggggagccccagaaatgcggttgctgaagaccccagtcaccacatccttctgcctgggtggcctctccaagccctggtggtgctgggggttgtatccccggccacctcctgtccaggtctccatccccctttggatgggaggcctctctgttacagccctccccatgctgtgccctgccatatacgtgggggactcagggtcctgactcaggggccctgccccctccacttggtactagctgtaagcggaacaccctgccccagggccggacttccagcccccagagccctctccctgtcactccctgaaacactattaatagctctgccgatagctggtgttgtcacaactgcctggaatccgaaggtggaggacaggcagccccgcgcccctgagactggagaccctccccagtgtggcatttcctgccaggggcggggggtggggcagctgtggggagacgggggtcttccttcaccagctcccctcgactcaagcccttgtcctcattatccggcccagaccaaagattccctcatccctgggggcagccctgccgctgtgtctcctttgtatcctaaatctttatttttctaggacatgttatgcctccattttcaattaaaataaagttatcggattacaccacca

SEQ ID NO: 369558 - DNA, 8689 bp, Homo sapiens
cggctgcgggcggcagtccggcagtggcggggcccggggggcgcccaagatggcggcgggcggcgcggagggcggctcgggccccggcgccgccatgggggactgcgcggagattaagtcgcaattccgcacgcgcgagggtttctacaagctactcccgggcgacggcgccgctcgcaggtcgggtccggcttccgcccagactccggtgccgcctcagccaccgcagcccccgcccggccctgcctccgcctccggtcccggcgctgcaggccccgcgtcgtccccgccgcccgcaggccccggacccgggcccgccctgcccgccgtgcgcctcagcctcgtgcgcctcggggagccggacagcgccggggccggggagccgcccgccacgcccgcggggctgggctcggggggagaccgcgtctgcttcaacttgggccgtgagctctatttctacccaggctgctgtcgtcgtgggagccaacggtccattgacctcaacaagccaattgacaagcggatctacaagggcacccagcccacctgccacgatttcaaccagttcactgctgccaccgagaccatctcgctgctggtgggcttctcagcgggtcaagtgcagtacctggatctcatcaaaaaggacaccagcaagctgttcaatgaggagcggttgatcgacaagaccaaggtgacatatctgaagtggctgcctgagtcggagagcctgttcctggcatcacacgccagtggccacctgtacctgtacaacgtcagccacccctgcgcctcggccccgccccagtacagcctgctgaagcagggcgagggcttctctgtctatgctgccaagagcaaggcaccccgcaacccgctggccaagtgggcggtgggtgaggggcccctcaacgagttcgccttctcgcccgatggccggcacctggcctgtgtgagccaggatggctgcctgcgcgtcttccacttcgactccatgctcctgcgtgggctcatgaagagctactttgggggcctgctgtgtgtgtgctggagccctgacggccgctacgtggtgacgggtggcgaagatgacctggtcaccgtgtggtccttcaccgagggccgcgtggtggctcgaggccatggccacaagtcctgggtcaacgctgtggcctttgacccctacaccacaagggcagaggaggcggcgacagcagccggtgctgatggggagcggagcggcgaagaggaggaggaggagcccgaggctgcgggcacaggctcggccgggggcgccccgctctctccactgcccaaggctggctccattacttaccgctttggctcggcgggccaggacacgcagttctgcctgtgggacctcactgaagacgtgctctacccgcacccgcccctggcccgcacccgcaccctccctggcacacctggcaccacgccaccggccgccagcagctcgaggggtggcgagcctggcccaggccccctgcctcgctcgctgtcccgctccaacagtctcccgcacccagctggcgggggcaaggcgggcggcccgggtgtggcggcagagcctggcacaccattcagcattggccgcttcgccacgctcacactgcaggagcggcgggaccggggggcagagaaggagcacaagcgctaccacagcctgggcaacatcagccggggtggcagtggcggcagtggcagtggtggggagaagcccagcggccctgttccccgcagccgcctggaccccgccaaggtgctgggcactgcgctgtgcccgcgcatccacgaggtgcccctgctggagccccttgtgtgcaagaagatcgcccaggagcggctcacagtcctcctgttcctggaggactgcatcatcactgcctgccaggagggcctcatctgcacctgggcccggccgggcaaggcgttcacagacgaggagaccgaggcccagacaggggaaggaagttggcccaggtcacccagcaagtcagtggtagagggcatctcctcccaaccaggcaactccccgagtggcacagtggtgtgaagccatggatatcgggcccccccaaccccatgcccccagcctcctagccataaccctccctgctgacctcacagatcaacgtattaacaagactaaccatgatggatggactgctccagtccccccacctgcacaaaatttgggggccccccagactggcccggacacgggcgatgtaatagcccttgtggcctcagccttgtcccccacccactgccaagtacaatgacctcttcctctgaaacatcagtgttaccctcatccctgtccccagcatgtgactggtcactcctggggagagactccccgcccctgccacaagagccccaggtctgcagtgtgcccctcagttgagtgggcagggccgggggtggtccagccctcgcccggcccccaccccagctgcccttgctattgtctgtgcttttgaagagtgttaaattatggaagcccctcaggttcctccctgtcccgcaggacctcttatttatactaaagttccctgttttctcagcgggtctgtccccttcggaggagatgatgtagaggacctgtgtgtgtactctgtggttctaggcagtccgctttccccagaggaggagtgcaggcctgctcccagcccagcgcctcccaccccttttcatagcaggaaaagccggagcccagggagggaacggacctgcgagtcacacaactggtgacccacaccagcggctggagcaggaccctcttggggagaagagcatcctgcccgcagccagggcccctcatcaaagtcctcggtgttttttaaattatcagaactgcccaggaccacgtttcccaggccctgcccagctgggactcctcggtccttgcctcctagtttctcaggcctggccctctcaaggcccaggcaccccaggccggttggaggccccgacttccactctggagaaccgtccaccctggaaagaagagctcagattcctcttggctctcggagccgcagggagtgtgtcttcccgcgccaccctccaccccccgaaatgtttctgtttctaatcccagcctgggcaggaatgtggctccccggccaggggccaaggagctattttggggtctcgtttgcccagggagggcttggctccaccactttcctcccccagcctttgggcagcaggtcacccctgttcaggctctgagggtgccccctcctggtcctgtcctcaccaccccttccccacctcctgggaaaaaaaaaaaaaaaaaaaaaaaagctggtataaagcagagagcctgagggctaaatttaactgtccgagtcggaatccatctctgagtcacccaagaagctgccctggcctcccgtccccttcccaggcctcaacccctttctcccacccagccccaacccccagccctcaccccctagcccccagttctggagcttgtcgggagcaagggggtggttgctactgggtcactcagcctcaattggccctgtttcagcaatgggcaggttcttcttgaaattcatcacacctgtggcttcctctgtgctctacctttttattggggtgacagtgtgacagctgagattctccatgcattccccctactctagcactgaagggttctgaagggccctggaaggagggagcttggggggctggcttgtgaggggttaaggctgggaggcgggaggggggctggaccaaggggtggggagaaggggaggaggcctcggccggccgcagagagaagtggccagagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgctgctgctgctgctgctgctgctgctgctgctgctgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgcccaaagctctggactccacagtgtccgcggtttgcgttgtgggccggaggctccgcagcgggccaatccggaggcgtgtggaggcggccgaaggtctgggaggagctagcgggatgcgaagcggccgaatcagggttgggggaggaaaagccacggggcggggctttggcgtccggccaataggagggcgagcgggccacccggaggcaccgcccccgcccagctgtggcccagctgtgccaccgagcgtcgagaagagggggctgggctggcagcgcgcgcggccatcctccttccactgcgcctgcgcacgccacgcgcatccgctcctgggacgcaagctcgagaaaagttgctgcaaactttctagcccgttccccgcccctcctcccggccagacccgccccccctgcggagccgggaattccgaggggcggagcgcaggccgagatggggaatgtgggggcctgcagaggaccctggagacggaggcgtgcagaagctcagtctcggggcggaggcttcgcgcccttagtcctcctggacggcccgttaccttctgcgttgtcccgatggggaaactgaggccctgagccagaagcacacgctggggggaggcagaaagcgcggccagaggcggagggaaaacaaagggagaatcacagacagacgggagggggacggacacacacaaggggacagagacccgagtggagagctggatctcgccttcccggcgtggggcgcagggtcggccagaaagaagatcgagaagagcggggagtgggggcgaaaaggggggacaggtgggggaggaggctggggaaagcccgagggaggaagagagggagggaggaacttcccaaagttgcaaaacatggctaccttgccactgaagccagagacggccatctccgtgcctgagggaggcctcccggtggcccccagccctgctctcccagaggctcacgccctaggcaccctttctgcacagcagccaccccccgccgctgccaccacctccagcaccagcctgcccttctcccctgactcccctggcctcctgcccaacttcccggcgcccccaccagaggggctgatgttgtcacccgcggccgtgcctgtctggtcagcagggctggaactaagcgcaggaacagaggggctgctggaagcggaaaaggggctggggacacaggccccccacaccatgctgaggctgccagaccccgaccctgaggggctgctcctgggggccaccgcagggggtgaggttgacgaggggttggaagctgaggccaaggttctgacccagctccagtcggtgcctgtggaggagcccttggaactgtgacccagtgtggccccgtggcctctcccgacattggtgctgaagacgcagggacaggaatgggaggggggagccccagaaatgcggttgctgaagaccccagtcaccacatccttctgcctgggtggcctctccaagccctggtggtgctgggggttgtatccccggccacctcctgtccaggtctccatccccctttggatgggaggcctctctgttacagccctccccatgctgtgccctgccatatacgtgggggactcagggtcctgactcaggggccctgccccctccacttggtactagctgtaagcggaacaccctgccccagggccggacttccagcccccagagccctctccctgtcactccctgaaacactattaatagctctgccgatagctggtgttgtcacaactgcctggaatccgaaggtggaggacaggcagccccgcgcccctgagactggagaccctccccagtgtggcatttcctgccaggggcggggggtggggcagctgtggggagacgggggtcttccttcaccagctcccctcgactcaagcccttgtcctcattatccggcccagaccaaagattccctcatccctgggggcagccctgccgctgtgtctcctttgtatcctaaatctttatttttctaggacatgttatgcctccattttcaattaaaataaagttatcggattacaccacca

SEQ ID NO: 369559 - DNA, 8477 bp, Homo sapiens
cggctgcgggcggcagtccggcagtggcggggcccggggggcgcccaagatggcggcgggcggcgcggagggcggctcgggccccggcgccgccatgggggactgcgcggagattaagtcgcaattccgcacgcgcgagggtttctacaagctactcccgggcgacggcgccgctcgcaggtcgggtccggcttccgcccagactccggtgccgcctcagccaccgcagcccccgcccggccctgcctccgcctccggtcccggcgctgcaggccccgcgtcgtccccgccgcccgcaggccccggacccgggcccgccctgcccgccgtgcgcctcagcctcgtgcgcctcggggagccggacagcgccggggccggggagccgcccgccacgcccgcggggctgggctcggggggagaccgcgtctgcttcaacttgggccgtgagctctatttctacccaggctgctgtcgtcgtgggagccaacggtccattgacctcaacaagccaattgacaagcggatctacaagggcacccagcccacctgccacgatttcaaccagttcactgctgccaccgagaccatctcgctgctggtgggcttctcagcgggtcaagtgcagtacctggatctcatcaaaaaggacaccagcaagctgttcaatgaggagcggttgatcgacaagaccaaggtgacatatctgaagtggctgcctgagtcggagagcctgttcctggcatcacacgccagtggccacctgtacctgtacaacgtcagccacccctgcgcctcggccccgccccagtacagcctgctgaagcagggcgagggcttctctgtctatgctgccaagagcaaggcaccccgcaacccgctggccaagtgggcggtgggtgaggggcccctcaacgagttcgccttctcgcccgatggccggcacctggcctgtgtgagccaggatggctgcctgcgcgtcttccacttcgactccatgctcctgcgtgggctcatgaagagctactttgggggcctgctgtgtgtgtgctggagccctgacggccgctacgtggtgacgggtggcgaagatgacctggtcaccgtgtggtccttcaccgagggccgcgtggtggctcgaggccatggccacaagtcctgggtcaacgctgtggcctttgacccctacaccacaagggcagaggaggcggcgacagcagccggtgctgatggggagcggagcggcgaagaggaggaggaggagcccgaggctgcgggcacaggctcggccgggggcgccccgctctctccactgcccaaggctggctccattacttaccgctttggctcggcgggccaggacacgcagttctgcctgtgggacctcactgaagacgtgctctacccgcacccgcccctggcccgcacccgcaccctccctggcacacctggcaccacgccaccggccgccagcagctcgaggggtggcgagcctggcccaggccccctgcctcgctcgctgtcccgctccaacagtctcccgcacccagctggcgggggcaaggcgggcggcccgggtgtggcggcagagcctggcacaccattcagcattggccgcttcgccacgctcacactgcaggagcggcgggaccggggggcagagaaggagcacaagcgctaccacagcctgggcaacatcagccggggtggcagtggcggcagtggcagtggtggggagaagcccagcggccctgttccccgcagccgcctggaccccgccaaggtgctgggcactgcgctgtgcccgcgcatccacgaggtgcccctgctggagccccttgtgtgcaagaagatcgcccaggagcggctcacagtcctcctgttcctggaggactgcatcatcactgcctgccaggagggcctcatctgcacctgggcccggccgggcaaggcgttcacagacgaggagaccgaggcccagacaggggaaggaagttggcccaggtcacccagcaagtcagtggtagagggcatctcctcccaaccaggcaactccccgagtggcacagtggtgtgaagccatggatatcgggcccccccaaccccatgcccccagcctcctagccataaccctccctgctgacctcacagatcaacgtattaacaagactaaccatgatggatggactgctccagtccccccacctgcacaaaatttgggggccccccagactggcccggacacgggcgatgtaatagcccttgtggcctcagccttgtcccccacccactgccaagtacaatgacctcttcctctgaaacatcagtgttaccctcatccctgtccccagcatgtgactggtcactcctggggagagactccccgcccctgccacaagagccccaggtctgcagtgtgcccctcagttgagtgggcagggccgggggtggtccagccctcgcccggcccccaccccagctgcccttgctattgtctgtgcttttgaagagtgttaaattatggaagcccctcaggttcctccctgtcccgcaggacctcttatttatactaaagttccctgttttctcagcgggtctgtccccttcggaggagatgatgtagaggacctgtgtgtgtactctgtggttctaggcagtccgctttccccagaggaggagtgcaggcctgctcccagcccagcgcctcccaccccttttcatagcaggaaaagccggagcccagggagggaacggacctgcgagtcacacaactggtgacccacaccagcggctggagcaggaccctcttggggagaagagcatcctgcccgcagccagggcccctcatcaaagtcctcggtgttttttaaattatcagaactgcccaggaccacgtttcccaggccctgcccagctgggactcctcggtccttgcctcctagtttctcaggcctggccctctcaaggcccaggcaccccaggccggttggaggccccgacttccactctggagaaccgtccaccctggaaagaagagctcagattcctcttggctctcggagccgcagggagtgtgtcttcccgcgccaccctccaccccccgaaatgtttctgtttctaatcccagcctgggcaggaatgtggctccccggccaggggccaaggagctattttggggtctcgtttgcccagggagggcttggctccaccactttcctcccccagcctttgggcagcaggtcacccctgttcaggctctgagggtgccccctcctggtcctgtcctcaccaccccttccccacctcctgggaaaaaaaaaaaaaaaaaaaaaaaagctggtataaagcagagagcctgagggctaaatttaactgtccgagtcggaatccatctctgagtcacccaagaagctgccctggcctcccgtccccttcccaggcctcaacccctttctcccacccagccccaacccccagccctcaccccctagcccccagttctggagcttgtcgggagcaagggggtggttgctactgggtcactcagcctcaattggccctgtttcagcaatgggcaggttcttcttgaaattcatcacacctgtggcttcctctgtgctctacctttttattggggtgacagtgtgacagctgagattctccatgcattccccctactctagcactgaagggttctgaagggccctggaaggagggagcttggggggctggcttgtgaggggttaaggctgggaggcgggaggggggctggaccaaggggtggggagaaggggaggaggcctcggccggccgcagagagaagtggccagagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgcccaaagctctggactccacagtgtccgcggtttgcgttgtgggccggaggctccgcagcgggccaatccggaggcgtgtggaggcggccgaaggtctgggaggagctagcgggatgcgaagcggccgaatcagggttgggggaggaaaagccacggggcggggctttggcgtccggccaataggagggcgagcgggccacccggaggcaccgcccccgcccagctgtggcccagctgtgccaccgagcgtcgagaagagggggctgggctggcagcgcgcgcggccatcctccttccactgcgcctgcgcacgccacgcgcatccgctcctgggacgcaagctcgagaaaagttgctgcaaactttctagcccgttccccgcccctcctcccggccagacccgccccccctgcggagccgggaattccgaggggcggagcgcaggccgagatggggaatgtgggggcctgcagaggaccctggagacggaggcgtgcagaagctcagtctcggggcggaggcttcgcgcccttagtcctcctggacggcccgttaccttctgcgttgtcccgatggggaaactgaggccctgagccagaagcacacgctggggggaggcagaaagcgcggccagaggcggagggaaaacaaagggagaatcacagacagacgggagggggacggacacacacaaggggacagagacccgagtggagagctggatctcgccttcccggcgtggggcgcagggtcggccagaaagaagatcgagaagagcggggagtgggggcgaaaaggggggacaggtgggggaggaggctggggaaagcccgagggaggaagagagggagggaggaacttcccaaagttgcaaaacatggctaccttgccactgaagccagagacggccatctccgtgcctgagggaggcctcccggtggcccccagccctgctctcccagaggctcacgccctaggcaccctttctgcacagcagccaccccccgccgctgccaccacctccagcaccagcctgcccttctcccctgactcccctggcctcctgcccaacttcccggcgcccccaccagaggggctgatgttgtcacccgcggccgtgcctgtctggtcagcagggctggaactaagcgcaggaacagaggggctgctggaagcggaaaaggggctggggacacaggccccccacaccatgctgaggctgccagaccccgaccctgaggggctgctcctgggggccaccgcagggggtgaggttgacgaggggttggaagctgaggccaaggttctgacccagctccagtcggtgcctgtggaggagcccttggaactgtgacccagtgtggccccgtggcctctcccgacattggtgctgaagacgcagggacaggaatgggaggggggagccccagaaatgcggttgctgaagaccccagtcaccacatccttctgcctgggtggcctctccaagccctggtggtgctgggggttgtatccccggccacctcctgtccaggtctccatccccctttggatgggaggcctctctgttacagccctccccatgctgtgccctgccatatacgtgggggactcagggtcctgactcaggggccctgccccctccacttggtactagctgtaagcggaacaccctgccccagggccggacttccagcccccagagccctctccctgtcactccctgaaacactattaatagctctgccgatagctggtgttgtcacaactgcctggaatccgaaggtggaggacaggcagccccgcgcccctgagactggagaccctccccagtgtggcatttcctgccaggggcggggggtggggcagctgtggggagacgggggtcttccttcaccagctcccctcgactcaagcccttgtcctcattatccggcccagaccaaagattccctcatccctgggggcagccctgccgctgtgtctcctttgtatcctaaatctttatttttctaggacatgttatgcctccattttcaattaaaataaagttatcggattacaccacca

SEQ ID NO: 369560 - DNA, 8219 bp, Homo sapiens
cggctgcgggcggcagtccggcagtggcggggcccggggggcgcccaagatggcggcgggcggcgcggagggcggctcgggccccggcgccgccatgggggactgcgcggagattaagtcgcaattccgcacgcgcgagggtttctacaagctactcccgggcgacggcgccgctcgcaggtcgggtccggcttccgcccagactccggtgccgcctcagccaccgcagcccccgcccggccctgcctccgcctccggtcccggcgctgcaggccccgcgtcgtccccgccgcccgcaggccccggacccgggcccgccctgcccgccgtgcgcctcagcctcgtgcgcctcggggagccggacagcgccggggccggggagccgcccgccacgcccgcggggctgggctcggggggagaccgcgtctgcttcaacttgggccgtgagctctatttctacccaggctgctgtcgtcgtgggagccaacggtccattgacctcaacaagccaattgacaagcggatctacaagggcacccagcccacctgccacgatttcaaccagttcactgctgccaccgagaccatctcgctgctggtgggcttctcagcgggtcaagtgcagtacctggatctcatcaaaaaggacaccagcaagctgttcaatgaggagcggttgatcgacaagaccaaggtgacatatctgaagtggctgcctgagtcggagagcctgttcctggcatcacacgccagtggccacctgtacctgtacaacgtcagccacccctgcgcctcggccccgccccagtacagcctgctgaagcagggcgagggcttctctgtctatgctgccaagagcaaggcaccccgcaacccgctggccaagtgggcggtgggtgaggggcccctcaacgagttcgccttctcgcccgatggccggcacctggcctgtgtgagccaggatggctgcctgcgcgtcttccacttcgactccatgctcctgcgtgggctcatgaagagctactttgggggcctgctgtgtgtgtgctggagccctgacggccgctacgtggtgacgggtggcgaagatgacctggtcaccgtgtggtccttcaccgagggccgcgtggtggctcgaggccatggccacaagtcctgggtcaacgctgtggcctttgacccctacaccacaagggcagaggaggcggcgacagcagccggtgctgatggggagcggagcggcgaagaggaggaggaggagcccgaggctgcgggcacaggctcggccgggggcgccccgctctctccactgcccaaggctggctccattacttaccgctttggctcggcgggccaggacacgcagttctgcctgtgggacctcactgaagacgtgctctacccgcacccgcccctggcccgcacccgcaccctccctggcacacctggcaccacgccaccggccgccagcagctcgaggggtggcgagcctggcccaggccccctgcctcgctcgctgtcccgctccaacagtctcccgcacccagctggcgggggcaaggcgggcggcccgggtgtggcggcagagcctggcacaccattcagcattggccgcttcgccacgctcacactgcaggagcggcgggaccggggggcagagaaggagcacaagcgctaccacagcctgggcaacatcagccggggtggcagtggcggcagtggcagtggtggggagaagcccagcggccctgttccccgcagccgcctggaccccgccaaggtgctgggcactgcgctgtgcccgcgcatccacgaggtgcccctgctggagccccttgtgtgcaagaagatcgcccaggagcggctcacagtcctcctgttcctggaggactgcatcatcactgcctgccaggagggcctcatctgcacctgggcccggccgggcaaggcgttcacagacgaggagaccgaggcccagacaggggaaggaagttggcccaggtcacccagcaagtcagtggtagagggcatctcctcccaaccaggcaactccccgagtggcacagtggtgtgaagccatggatatcgggcccccccaaccccatgcccccagcctcctagccataaccctccctgctgacctcacagatcaacgtattaacaagactaaccatgatggatggactgctccagtccccccacctgcacaaaatttgggggccccccagactggcccggacacgggcgatgtaatagcccttgtggcctcagccttgtcccccacccactgccaagtacaatgacctcttcctctgaaacatcagtgttaccctcatccctgtccccagcatgtgactggtcactcctggggagagactccccgcccctgccacaagagccccaggtctgcagtgtgcccctcagttgagtgggcagggccgggggtggtccagccctcgcccggcccccaccccagctgcccttgctattgtctgtgcttttgaagagtgttaaattatggaagcccctcaggttcctccctgtcccgcaggacctcttatttatactaaagttccctgttttctcagcgggtctgtccccttcggaggagatgatgtagaggacctgtgtgtgtactctgtggttctaggcagtccgctttccccagaggaggagtgcaggcctgctcccagcccagcgcctcccaccccttttcatagcaggaaaagccggagcccagggagggaacggacctgcgagtcacacaactggtgacccacaccagcggctggagcaggaccctcttggggagaagagcatcctgcccgcagccagggcccctcatcaaagtcctcggtgttttttaaattatcagaactgcccaggaccacgtttcccaggccctgcccagctgggactcctcggtccttgcctcctagtttctcaggcctggccctctcaaggcccaggcaccccaggccggttggaggccccgacttccactctggagaaccgtccaccctggaaagaagagctcagattcctcttggctctcggagccgcagggagtgtgtcttcccgcgccaccctccaccccccgaaatgtttctgtttctaatcccagcctgggcaggaatgtggctccccggccaggggccaaggagctattttggggtctcgtttgcccagggagggcttggctccaccactttcctcccccagcctttgggcagcaggtcacccctgttcaggctctgagggtgccccctcctggtcctgtcctcaccaccccttccccacctcctgggaaaaaaaaaaaaaaaaaaaaaaaagctggtataaagcagagagcctgagggctaaatttaactgtccgagtcggaatccatctctgagtcacccaagaagctgccctggcctcccgtccccttcccaggcctcaacccctttctcccacccagccccaacccccagccctcaccccctagcccccagttctggagcttgtcgggagcaagggggtggttgctactgggtcactcagcctcaattggccctgtttcagcaatgggcaggttcttcttgaaattcatcacacctgtggcttcctctgtgctctacctttttattggggtgacagtgtgacagctgagattctccatgcattccccctactctagcactgaagggttctgaagggccctggaaggagggagcttggggggctggcttgtgaggggttaaggctgggaggcgggaggggggctggaccaaggggtggggagaaggggaggaggcctcggccggccgcagagagaagtggccagagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccggccgtggctgtgggccagtgcccgctggtggggccaggccccatgcaccgccgccacctgctgctccctgccagggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgcccaaagctctggactccacagtgtccgcggtttgcgttgtgggccggaggctccgcagcgggccaatccggaggcgtgtggaggcggccgaaggtctgggaggagctagcgggatgcgaagcggccgaatcagggttgggggaggaaaagccacggggcggggctttggcgtccggccaataggagggcgagcgggccacccggaggcaccgcccccgcccagctgtggcccagctgtgccaccgagcgtcgagaagagggggctgggctggcagcgcgcgcggccatcctccttccactgcgcctgcgcacgccacgcgcatccgctcctgggacgcaagctcgagaaaagttgctgcaaactttctagcccgttccccgcccctcctcccggccagacccgccccccctgcggagccgggaattccgaggggcggagcgcaggccgagatggggaatgtgggggcctgcagaggaccctggagacggaggcgtgcagaagctcagtctcggggcggaggcttcgcgcccttagtcctcctggacggcccgttaccttctgcgttgtcccgatggggaaactgaggccctgagccagaagcacacgctggggggaggcagaaagcgcggccagaggcggagggaaaacaaagggagaatcacagacagacgggagggggacggacacacacaaggggacagagacccgagtggagagctggatctcgccttcccggcgtggggcgcagggtcggccagaaagaagatcgagaagagcggggagtgggggcgaaaaggggggacaggtgggggaggaggctggggaaagcccgagggaggaagagagggagggaggaacttcccaaagttgcaaaacatggctaccttgccactgaagccagagacggccatctccgtgcctgagggaggcctcccggtggcccccagccctgctctcccagaggctcacgccctaggcaccctttctgcacagcagccaccccccgccgctgccaccacctccagcaccagcctgcccttctcccctgactcccctggcctcctgcccaacttcccggcgcccccaccagaggggctgatgttgtcacccgcggccgtgcctgtctggtcagcagggctggaactaagcgcaggaacagaggggctgctggaagcggaaaaggggctggggacacaggccccccacaccatgctgaggctgccagaccccgaccctgaggggctgctcctgggggccaccgcagggggtgaggttgacgaggggttggaagctgaggccaaggttctgacccagctccagtcggtgcctgtggaggagcccttggaactgtgacccagtgtggccccgtggcctctcccgacattggtgctgaagacgcagggacaggaatgggaggggggagccccagaaatgcggttgctgaagaccccagtcaccacatccttctgcctgggtggcctctccaagccctggtggtgctgggggttgtatccccggccacctcctgtccaggtctccatccccctttggatgggaggcctctctgttacagccctccccatgctgtgccctgccatatacgtgggggactcagggtcctgactcaggggccctgccccctccacttggtactagctgtaagcggaacaccctgccccagggccggacttccagcccccagagccctctccctgtcactccctgaaacactattaatagctctgccgatagctggtgttgtcacaactgcctggaatccgaaggtggaggacaggcagccccgcgcccctgagactggagaccctccccagtgtggcatttcctgccaggggcggggggtggggcagctgtggggagacgggggtcttccttcaccagctcccctcgactcaagcccttgtcctcattatccggcccagaccaaagattccctcatccctgggggcagccctgccgctgtgtctcctttgtatcctaaatctttatttttctaggacatgttatgcctccattttcaattaaaataaagttatcggattacaccacca

SEQ ID NO: 369561 - DNA, 8651 bp, Homo sapiens
cggctgcgggcggcagtccggcagtggcggggcccggggggcgcccaagatggcggcgggcggcgcggagggcggctcgggccccggcgccgccatgggggactgcgcggagattaagtcgcaattccgcacgcgcgagggtttctacaagctactcccgggcgacggcgccgctcgcaggtcgggtccggcttccgcccagactccggtgccgcctcagccaccgcagcccccgcccggccctgcctccgcctccggtcccggcgctgcaggccccgcgtcgtccccgccgcccgcaggccccggacccgggcccgccctgcccgccgtgcgcctcagcctcgtgcgcctcggggagccggacagcgccggggccggggagccgcccgccacgcccgcggggctgggctcggggggagaccgcgtctgcttcaacttgggccgtgagctctatttctacccaggctgctgtcgtcgtgggagccaacggtccattgacctcaacaagccaattgacaagcggatctacaagggcacccagcccacctgccacgatttcaaccagttcactgctgccaccgagaccatctcgctgctggtgggcttctcagcgggtcaagtgcagtacctggatctcatcaaaaaggacaccagcaagctgttcaatgaggagcggttgatcgacaagaccaaggtgacatatctgaagtggctgcctgagtcggagagcctgttcctggcatcacacgccagtggccacctgtacctgtacaacgtcagccacccctgcgcctcggccccgccccagtacagcctgctgaagcagggcgagggcttctctgtctatgctgccaagagcaaggcaccccgcaacccgctggccaagtgggcggtgggtgaggggcccctcaacgagttcgccttctcgcccgatggccggcacctggcctgtgtgagccaggatggctgcctgcgcgtcttccacttcgactccatgctcctgcgtgggctcatgaagagctactttgggggcctgctgtgtgtgtgctggagccctgacggccgctacgtggtgacgggtggcgaagatgacctggtcaccgtgtggtccttcaccgagggccgcgtggtggctcgaggccatggccacaagtcctgggtcaacgctgtggcctttgacccctacaccacaagggcagaggaggcggcgacagcagccggtgctgatggggagcggagcggcgaagaggaggaggaggagcccgaggctgcgggcacaggctcggccgggggcgccccgctctctccactgcccaaggctggctccattacttaccgctttggctcggcgggccaggacacgcagttctgcctgtgggacctcactgaagacgtgctctacccgcacccgcccctggcccgcacccgcaccctccctggcacacctggcaccacgccaccggccgccagcagctcgaggggtggcgagcctggcccaggccccctgcctcgctcgctgtcccgctccaacagtctcccgcacccagctggcgggggcaaggcgggcggcccgggtgtggcggcagagcctggcacaccattcagcattggccgcttcgccacgctcacactgcaggagcggcgggaccggggggcagagaaggagcacaagcgctaccacagcctgggcaacatcagccggggtggcagtggcggcagtggcagtggtggggagaagcccagcggccctgttccccgcagccgcctggaccccgccaaggtgctgggcactgcgctgtgcccgcgcatccacgaggtgcccctgctggagccccttgtgtgcaagaagatcgcccaggagcggctcacagtcctcctgttcctggaggactgcatcatcactgcctgccaggagggcctcatctgcacctgggcccggccgggcaaggcgttcacagacgaggagaccgaggcccagacaggggaaggaagttggcccaggtcacccagcaagtcagtggtagagggcatctcctcccaaccaggcaactccccgagtggcacagtggtgtgaagccatggatatcgggcccccccaaccccatgcccccagcctcctagccataaccctccctgctgacctcacagatcaacgtattaacaagactaaccatgatggatggactgctccagtccccccacctgcacaaaatttgggggccccccagactggcccggacacgggcgatgtaatagcccttgtggcctcagccttgtcccccacccactgccaagtacaatgacctcttcctctgaaacatcagtgttaccctcatccctgtccccagcatgtgactggtcactcctggggagagactccccgcccctgccacaagagccccaggtctgcagtgtgcccctcagttgagtgggcagggccgggggtggtccagccctcgcccggcccccaccccagctgcccttgctattgtctgtgcttttgaagagtgttaaattatggaagcccctcaggttcctccctgtcccgcaggacctcttatttatactaaagttccctgttttctcagcgggtctgtccccttcggaggagatgatgtagaggacctgtgtgtgtactctgtggttctaggcagtccgctttccccagaggaggagtgcaggcctgctcccagcccagcgcctcccaccccttttcatagcaggaaaagccggagcccagggagggaacggacctgcgagtcacacaactggtgacccacaccagcggctggagcaggaccctcttggggagaagagcatcctgcccgcagccagggcccctcatcaaagtcctcggtgttttttaaattatcagaactgcccaggaccacgtttcccaggccctgcccagctgggactcctcggtccttgcctcctagtttctcaggcctggccctctcaaggcccaggcaccccaggccggttggaggccccgacttccactctggagaaccgtccaccctggaaagaagagctcagattcctcttggctctcggagccgcagggagtgtgtcttcccgcgccaccctccaccccccgaaatgtttctgtttctaatcccagcctgggcaggaatgtggctccccggccaggggccaaggagctattttggggtctcgtttgcccagggagggcttggctccaccactttcctcccccagcctttgggcagcaggtcacccctgttcaggctctgagggtgccccctcctggtcctgtcctcaccaccccttccccacctcctgggaaaaaaaaaaaaaaaaaaaaaaaagctggtataaagcagagagcctgagggctaaatttaactgtccgagtcggaatccatctctgagtcacccaagaagctgccctggcctcccgtccccttcccaggcctcaacccctttctcccacccagccccaacccccagccctcaccccctagcccccagttctggagcttgtcgggagcaagggggtggttgctactgggtcactcagcctcaattggccctgtttcagcaatgggcaggttcttcttgaaattcatcacacctgtggcttcctctgtgctctacctttttattggggtgacagtgtgacagctgagattctccatgcattccccctactctagcactgaagggttctgaagggccctggaaggagggagcttggggggctggcttgtgaggggttaaggctgggaggcgggaggggggctggaccaaggggtggggagaaggggaggaggcctcggccggccgcagagagaagtggccagagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgctgctgctgctgctgctgctgctgctgctgctgctgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgcccaaagctctggactccacagtgtccgcggtttgcgttgtgggccggaggctccgcagcgggccaatccggaggcgtgtggaggcggccgaaggtctgggaggagctagcgggatgcgaagcggccgaatcagggttgggggaggaaaagccacggggcggggctttggcgtccggccaataggagggcgagcgggccacccggaggcaccgcccccgcccagctgtggcccagctgtgccaccgagcgtcgagaagagggggctgggctggcagcgcgcgcggccatcctccttccactgcgcctgcgcacgccacgcgcatccgctcctgggacgcaagctcgagaaaagttgctgcaaactttctagcccgttccccgcccctcctcccggccagacccgccccccctgcggagccgggaattccgaggggcggagcgcaggccgagatggggaatgtgggggcctgcagaggaccctggagacggaggcgtgcagaagctcagtctcggggcggaggcttcgcgcccttagtcctcctggacggcccgttaccttctgcgttgtcccgatggggaaactgaggccctgagccagaagcacacgctggggggaggcagaaagcgcggccagaggcggagggaaaacaaagggagaatcacagacagacgggagggggacggacacacacaaggggacagagacccgagtggagagctggatctcgccttcccggcgtggggcgcagggtcggccagaaagaagatcgagaagagcggggagtgggggcgaaaaggggggacaggtgggggaggaggctggggaaagcccgagggaggaagagagggagggaggaacttcccaaagttgcaaaacatggctaccttgccactgaagccagagacggccatctccgtgcctgagggaggcctcccggtggcccccagccctgctctcccagaggctcacgccctaggcaccctttctgcacagcagccaccccccgccgctgccaccacctccagcaccagcctgcccttctcccctgactcccctggcctcctgcccaacttcccggcgcccccaccagaggggctgatgttgtcacccgcggccgtgcctgtctggtcagcagggctggaactaagcgcaggaacagaggggctgctggaagcggaaaaggggctggggacacaggccccccacaccatgctgaggctgccagaccccgaccctgaggggctgctcctgggggccaccgcagggggtgaggttgacgaggggttggaagctgaggccaaggttctgacccagctccagtcggtgcctgtggaggagcccttggaactgtgacccagtgtggccccgtggcctctcccgacattggtgctgaagacgcagggacaggaatgggaggggggagccccagaaatgcggttgctgaagaccccagtcaccacatccttctgcctgggtggcctctccaagccctggtggtgctgggggttgtatccccggccacctcctgtccaggtctccatccccctttggatgggaggcctctctgttacagccctccccatgctgtgccctgccatatacgtgggggactcagggtcctgactcaggggccctgccccctccacttggtactagctgtaagcggaacaccctgccccagggccggacttccagcccccagagccctctccctgtcactccctgaaacactattaatagctctgccgatagctggtgttgtcacaactgcctggaatccgaaggtggaggacaggcagccccgcgcccctgagactggagaccctccccagtgtggcatttcctgccaggggcggggggtggggcagctgtggggagacgggggtcttccttcaccagctcccctcgactcaagcccttgtcctcattatccggcccagaccaaagattccctcatccctgggggcagccctgccgctgtgtctcctttgtatcctaaatctttatttttctaggacatgttatgcctccattttcaattaaaataaagttatcggattacaccacca

SEQ ID NO: 369562 - DNA, 6314 bp, Homo sapiens
cggctgcgggcggcagtccggcagtggcggggcccggggggcgcccaagatggcggcgggcggcgcggagggcggctcgggccccggcgccgccatgggggactgcgcggagattaagtcgcaattccgcacgcgcgagggtttctacaagctactcccgggcgacggcgccgctcgcaggtcgggtccggcttccgcccagactccggtgccgcctcagccaccgcagcccccgcccggccctgcctccgcctccggtcccggcgctgcaggccccgcgtcgtccccgccgcccgcaggccccggacccgggcccgccctgcccgccgtgcgcctcagcctcgtgcgcctcggggagccggacagcgccggggccggggagccgcccgccacgcccgcggggctgggctcggggggagaccgcgtctgcttcaacttgggccgtgagctctatttctacccaggctgctgtcgtcgtgggagccaacggtccattgacctcaacaagccaattgacaagcggatctacaagggcacccagcccacctgccacgatttcaaccagttcactgctgccaccgagaccatctcgctgctggtgggcttctcagcgggtcaagtgcagtacctggatctcatcaaaaaggacaccagcaagctgttcaatgaggagcggttgatcgacaagaccaaggtgacatatctgaagtggctgcctgagtcggagagcctgttcctggcatcacacgccagtggccacctgtacctgtacaacgtcagccacccctgcgcctcggccccgccccagtacagcctgctgaagcagggcgagggcttctctgtctatgctgccaagagcaaggcaccccgcaacccgctggccaagtgggcggtgggtgaggggcccctcaacgagttcgccttctcgcccgatggccggcacctggcctgtgtgagccaggatggctgcctgcgcgtcttccacttcgactccatgctcctgcgtgggctcatgaagagctactttgggggcctgctgtgtgtgtgctggagccctgacggccgctacgtggtgacgggtggcgaagatgacctggtcaccgtgtggtccttcaccgagggccgcgtggtggctcgaggccatggccacaagtcctgggtcaacgctgtggcctttgacccctacaccacaagggcagaggaggcggcgacagcagccggtgctgatggggagcggagcggcgaagaggaggaggaggagcccgaggctgcgggcacaggctcggccgggggcgccccgctctctccactgcccaaggctggctccattacttaccgctttggctcggcgggccaggacacgcagttctgcctgtgggacctcactgaagacgtgctctacccgcacccgcccctggcccgcacccgcaccctccctggcacacctggcaccacgccaccggccgccagcagctcgaggggtggcgagcctggcccaggccccctgcctcgctcgctgtcccgctccaacagtctcccgcacccagctggcgggggcaaggcgggcggcccgggtgtggcggcagagcctggcacaccattcagcattggccgcttcgccacgctcacactgcaggagcggcgggaccggggggcagagaaggagcacaagcgctaccacagcctgggcaacatcagccggggtggcagtggcggcagtggcagtggtggggagaagcccagcggccctgttccccgcagccgcctggaccccgccaaggtgctgggcactgcgctgtgcccgcgcatccacgaggtgcccctgctggagccccttgtgtgcaagaagatcgcccaggagcggctcacagtcctcctgttcctggaggactgcatcatcactgcctgccaggagggcctcatctgcacctgggcccggccgggcaaggcgttcacagacgaggagaccgaggcccagacaggggaaggaagttggcccaggtcacccagcaagtcagtggtagagggcatctcctcccaaccaggcaactccccgagtggcacagtggtgtgaagccatggatatcgggcccccccaaccccatgcccccagcctcctagccataaccctccctgctgacctcacagatcaacgtattaacaagactaaccatgatggatggactgctccagtccccccacctgcacaaaatttgggggccccccagactggcccggacacgggcgatgtaatagcccttgtggcctcagccttgtcccccacccactgccaagtacaatgacctcttcctctgaaacatcagtgttaccctcatccctgtccccagcatgtgactggtcactcctggggagagactccccgcccctgccacaagagccccaggtctgcagtgtgcccctcagttgagtgggcagggccgggggtggtccagccctcgcccggcccccaccccagctgcccttgctattgtctgtgcttttgaagagtgttaaattatggaagcccctcaggttcctccctgtcccgcaggacctcttatttatactaaagttccctgttttctcagcgggtctgtccccttcggaggagatgatgtagaggacctgtgtgtgtactctgtggttctaggcagtccgctttccccagaggaggagtgcaggcctgctcccagcccagcgcctcccaccccttttcatagcaggaaaagccggagcccagggagggaacggacctgcgagtcacacaactggtgacccacaccagcggctggagcaggaccctcttggggagaagagcatcctgcccgcagccagggcccctcatcaaagtcctcggtgttttttaaattatcagaactgcccaggaccacgtttcccaggccctgcccagctgggactcctcggtccttgcctcctagtttctcaggcctggccctctcaaggcccaggcaccccaggccggttggaggccccgacttccactctggagaaccgtccaccctggaaagaagagctcagattcctcttggctctcggagccgcagggagtgtgtcttcccgcgccaccctccaccccccgaaatgtttctgtttctaatcccagcctgggcaggaatgtggctccccggccaggggccaaggagctattttggggtctcgtttgcccagggagggcttggctccaccactttcctcccccagcctttgggcagcaggtcacccctgttcaggctctgagggtgccccctcctggtcctgtcctcaccaccccttccccacctcctgggaaaaaaaaaaaaaaaaaaaaaaaagctggtataaagcagagagcctgagggctaaatttaactgtccgagtcggaatccatctctgagtcacccaagaagctgccctggcctcccgtccccttcccaggcctcaacccctttctcccacccagccccaacccccagccctcaccccctagcccccagttctggagcttgtcgggagcaagggggtggttgctactgggtcactcagcctcaattggccctgtttcagcaatgggcaggttcttcttgaaattcatcacacctgtggcttcctctgtgctctacctttttattggggtgacagtgtgacagctgagattctccatgcattccccctactctagcactgaagggttctgaagggccctggaaggagggagcttggggggctggcttgtgaggggttaaggctgggaggcgggaggggggctggaccaaggggtggggagaaggggaggaggcctcggccggccgcagagagaagtggccagagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggtgagcgggggcggggtaggtacctgtggcccctgctcggctgcgggaacctccccatgctccctccataaagttggagtaaggacagtgcctaccttctggggtcctgaatcactcattccccagagcacctgctctgtgcccatctactactgaggacccagcagtgacctagacttacagtccagtgggggaacacagagcagtcttcagacagtaaggccccagagtgatcagggctgagacaatggagtgcagggggtgggggactcctgactcagcaaggaaggtcctggagggctttctggagtggggagctatctgagctgagacttggagggatgagaagcaggagaggactcctcctcccttaggccgtctctcttcaccgtgtaacaagctgtcatggcatgcttgctcggctctgggtgcccttttgctgaacaatactggggatccagcacggaccagatgagctctggtccctgccctcatccagttgcagtctagagaattagagaattatggagagtgtggcaggtgccctgaagggaagcaacaggatacaagaaaaaatgatggggccaggcacggtggctcacgcctgtaaccccagcaatttggcaggccgaagtgggtggattgcttgagcccaggagttcgagaccagcctgggcaatgtggtgagacccccgtctctacaaaaatgttttaaaaattggttgggcgtggtggcgcatgcctgtatactcagctactagggtggccgacgtgggcttgagcccaggaggtcaaggctgcagtgagctgtgattgtgccactgcactccagcctgggcaacggagagagactctgtctcaaaaataagataaactgaaattaaaaaataggctgggctggccgggcgtggtggctcacgcctgtaatctcagcactttgggaggccgaggcgggtggatcacgaggtcaggagatcgagaccatcttggctaacacggtgaaaccccatctctcctaaaaatacaaaaaattagccaggcgtggtggcgggcgcctgtagtcccagctactcaggaggctgaggcaggagaatggcgtgaacccgggaggcagagtttgcagtgagccgagatcgtgccactgcactccagcctgggcgacagagcgagactctgtctcagaaaaaaaaaaaaaaaaaaaaaaa

SEQ ID NO: 369563 - DNA, 2498 bp, Homo sapiens
cggctgcgggcggcagtccggcagtggcggggcccggggggcgcccaagatggcggcgggcggcgcggagggcggctcgggccccggcgccgccatgggggactgcgcggagattaagtcgcaattccgcacgcgcgagggtttctacaagctactcccgggcgacggcgccgctcgcaggtcgggtccggcttccgcccagactccggtgccgcctcagccaccgcagcccccgcccggccctgcctccgcctccggtcccggcgctgcaggccccgcgtcgtccccgccgcccgcaggccccggacccgggcccgccctgcccgccgtgcgcctcagcctcgtgcgcctcggggagccggacagcgccggggccggggagccgcccgccacgcccgcggggctgggctcggggggagaccgcgtctgcttcaacttgggccgtgagctctatttctacccaggctgctgtcgtcgtgggagccaacggtccattgacctcaacaagccaattgacaagcggatctacaagggcacccagcccacctgccacgatttcaaccagttcactgctgccaccgagaccatctcgctgctggtgggcttctcagcgggtcaagtgcagtacctggatctcatcaaaaaggacaccagcaagctgttcaatgaggagcggttgatcgacaagaccaaggtgacatatctgaagtggctgcctgagtcggagagcctgttcctggcatcacacgccagtggccacctgtacctgtacaacgtcagccacccctgcgcctcggccccgccccagtacagcctgctgaagcagggcgagggcttctctgtctatgctgccaagagcaaggcaccccgcaacccgctggccaagtgggcggtgggtgaggggcccctcaacgagttcgccttctcgcccgatggccggcacctggcctgtgtgagccaggatggctgcctgcgcgtcttccacttcgactccatgctcctgcgtgggctcatgaagagctactttgggggcctgctgtgtgtgtgctggagccctgacggccgctacgtggtgacgggtggcgaagatgacctggtcaccgtgtggtccttcaccgagggccgcgtggtggctcgaggccatggccacaagtcctgggtcaacgctgtggcctttgacccctacaccacaagggcagaggaggcggcgacagcagccggtgctgatggggagcggagcggcgaagaggaggaggaggagcccgaggctgcgggcacaggctcggccgggggcgccccgctctctccactgcccaaggctggctccattacttaccgctttggctcggcgggccaggacacgcagttctgcctgtgggacctcactgaagacgtgctctacccgcacccgcccctggcccgcacccgcaccctccctggcacacctggcaccacgccaccggccgccagcagctcgaggggtggcgagcctggcccaggccccctgcctcgctcgctgtcccgctccaacagtctcccgcacccagctggcgggggcaaggcgggcggcccgggtgtggcggcagagcctggcacaccattcagcattggccgcttcgccacgctcacactgcaggagcggcgggaccggggggcagagaaggagcacaagcgctaccacagcctgggcaacatcagccggggtggcagtggcggcagtggcagtggtggggagaagcccagcggccctgttccccgcagccgcctggaccccgccaaggtgctgggcactgcgctgtgcccgcgcatccacgaggtgcccctgctggagccccttgtgtgcaagaagatcgcccaggagcggctcacagtcctcctgttcctggaggactgcatcatcactgcctgccaggagggcctcatctgcacctgggcccggccgggcaaggcgttcacagacgaggagaccgaggcccagacaggggaaggaagttggcccaggtcacccagcaagtcagtggtagagggcatctcctcccaaccaggcaactccccgagtggcacagtggtgtgaagccatggatatcgggcccccccaaccccatgcccccagcctcctagccataaccctccctgctgacctcacagatcaacgtattaacaagactaaccatgatggatggactgctccagtccccccacctgcacaaaatttgggggccccccagactggcccggacacgggcgatgtaatagcccttgtggcctcagccttgtcccccacccactgccaagtacaatgacctcttcctctgaaacatcagtgttaccctcatccctgtccccagcatgtgactggtcactcctggggagagactccccgcccctgccacaagagccccaggtctgcagtgtgcccctcagttgagtgggcaaggacccgtggtgttttattcttagcccggtcgctataaccaactttgctggcaaatgttttg

SEQ ID NO: 369564 - DNA, 2450 bp, Homo sapiens
gcggccgcctactactactactgctcgaattcaagcttctaacgatgtacggggacatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgcccaaagctctggactccacagtgtccgcggtttgcgttgtgggccggaggctccgcagcgggccaatccggaggcgtgtggaggcggccgaaggtctgggaggagctagcgggatgcgaagcggccgaatcagggttgggggaggaaaagccacggggcggggctttggcgtccggccaataggagggcgagcgggccacccggaggcaccgcccccgcccagctgtggcccagctgtgccaccgagcgtcgagaagagggggctgggctggcagcgcgcgcggccatcctccttccactgcgcctgcgcacgccacgcgcatccgctcctgggacgcaagctcgagaaaagttgctgcaaactttctagcccgttccccgcccctcctcccggccagacccgccccccctgcggagccgggaattccgaggggcggagcgcaggccgagatggggaatgtgggggcctgcagaggaccctggagacggaggcgtgcagaagctcagtctcggggcggaggcttcgcgcccttagtcctcctggacggcccgttaccttctgcgttgtcccgatggggaaactgaggccctgagccagaagcacacgctggggggaggcagaaagcgcggccagaggcggagggaaaacaaagggagaatcacagacagacgggagggggacggacacacacaaggggacagagacccgagtggagagctggatctcgccttcccggcgtggggcgcagggtcggccagaaagaagatcgagaagagcggggagtgggggcgaaaaggggggacaggtgggggaggaggctggggaaagcccgagggaggaagagagggagggaggaacttcccaaagttgcaaaacatggctaccttgccactgaagccagagacggccatctccgtgcctgagggaggcctcccggtggcccccagccctgctctcccagaggctcacgccctaggcaccctttctgcacagcagccaccccccgccgctgccaccacctccagcaccagcctgcccttctcccctgactcccctggcctcctgcccaacttcccggcgcccccaccagaggggctgatgttgtcacccgcggccgtgcctgtctggtcagcagggctggaactaagcgcaggaacagaggggctgctggaagcggaaaaggggctggggacacaggccccccacaccatgctgaggctgccagaccccgaccctgaggggctgctcctgggggccaccgcagggggtgaggttgacgaggggttggaagctgaggccaaggttctgacccagctccagtcggtgcctgtggaggagcccttggaactgtgacccagtgtggccccgtggcctctcccgacattggtgctgaagacgcagggacaggaatgggaggggggagccccagaaatgcggttgctgaagaccccagtcaccacatccttctgcctgggtggcctctccaagccctggtggtgctgggggttgtatccccggccacctcctgtccaggtctccatccccctttggatgggaggcctctctgttacagccctccccatgctgtgccctgccatatacgtgggggactcagggtcctgactcaggggccctgccccctccacttggtactagctgtaagcggaacaccctgccccagggccggacttccagcccccagagccctctccctgtcactccctgaaacactattaatagctctgccgatagctggtgttgtcacaactgcctggaatccgaaggtggaggacaggcagccccgcgcccctgagactggagaccctccccagtgtggcatttcctgccaggggcggggggtggggcagctgtggggagacgggggtcttccttcaccagctcccctcgactcaagcccttgtcctcattatccggcccagaccaaagattccctcatccctgggggcagccctgccgctgtgtctcctttgtatcctaaatctttatttttctaggacatgttatgcctccattttcaattaaaataaagttatcggattacaccacca

SEQ ID NO: 369565 - DNA, 3251 bp, Homo sapiens
ccacttcttccacccccgggagtccaggcctccctgtccccacagtccctgagccacaagcctccaccccagctggtcccccacccaggctgcccagtttaacattcctagtcataggaccttgacttctgagaggcctgattgtcatctgtaaataaggggtaggactaaagcactcctcctggaggactgagagatgggctggaccggagcacttgagtctgggatatgtgaccatgctacctttgtctccctgtcctgttccttcccccagccccaaatccagggttttccaaagtgtggttcaagaaccacctgcatctgaatctagaggtactggatacaaccccacgtctgggccgttacccaggacattctacatgagaacgtgggggtggggccctggctgcacctgaactgtcacctggagtcagggtggaaggtggaagaactgggtcttatttccttctccccttgttctttagggtctgtccttctgcagactccgttaccccaccctaaccatcctgcacacccttggagccctctgggccaatgccctgtcccgcaaagggcttctcaggcatctcacctctatgggagggcatttttggcccccagaaccttacacggtgtttatgtggggaagcccctgggaagcagacagtcctagggtgaagctgagaggcagagagaaggggagacagacagagggtggggctttcccccttgtctccagtgccctttctggtgaccctcggttcttttcccccaccacccccccagcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgtgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgccca

SEQ ID NO: 369566 - DNA, 6588 bp, Homo sapiens
cggctgcgggcggcagtccggcagtggcggggcccggggggcgcccaagatggcggcgggcggcgcggagggcggctcgggccccggcgccgccatgggggactgcgcggagattaagtcgcaattccgcacgcgcgagggtttctacaagctactcccgggcgacggcgccgctcgcaggtcgggtccggcttccgcccagactccggtgccgcctcagccaccgcagcccccgcccggccctgcctccgcctccggtcccggcgctgcaggccccgcgtcgtccccgccgcccgcaggccccggacccgggcccgccctgcccgccgtgcgcctcagcctcgtgcgcctcggggagccggacagcgccggggccggggagccgcccgccacgcccgcggggctgggctcggggggagaccgcgtctgcttcaacttgggccgtgagctctatttctacccaggctgctgtcgtcgtgggagccaacggtccattgacctcaacaagccaattgacaagcggatctacaagggcacccagcccacctgccacgatttcaaccagttcactgctgccaccgagaccatctcgctgctggtgggcttctcagcgggtcaagtgcagtacctggatctcatcaaaaaggacaccagcaagctgttcaatgaggagcggttgatcgacaagaccaaggtgacatatctgaagtggctgcctgagtcggagagcctgttcctggcatcacacgccagtggccacctgtacctgtacaacgtcagccacccctgcgcctcggccccgccccagtacagcctgctgaagcagggcgagggcttctctgtctatgctgccaagagcaaggcaccccgcaacccgctggccaagtgggcggtgggtgaggggcccctcaacgagttcgccttctcgcccgatggccggcacctggcctgtgtgagccaggatggctgcctgcgcgtcttccacttcgactccatgctcctgcgtgggctcatgaagagctactttgggggcctgctgtgtgtgtgctggagccctgacggccgctacgtggtgacgggtggcgaagatgacctggtcaccgtgtggtccttcaccgagggccgcgtggtggctcgaggccatggccacaagtcctgggtcaacgctgtggcctttgacccctacaccacaagggcagaggaggcggcgacagcagccggtgctgatggggagcggagcggcgaagaggaggaggaggagcccgaggctgcgggcacaggctcggccgggggcgccccgctctctccactgcccaaggctggctccattacttaccgctttggctcggcgggccaggacacgcagttctgcctgtgggacctcactgaagacgtgctctacccgcacccgcccctggcccgcacccgcaccctccctggcacacctggcaccacgccaccggccgccagcagctcgaggggtggcgagcctggcccaggccccctgcctcgctcgctgtcccgctccaacagtctcccgcacccagctggcgggggcaaggcgggcggcccgggtgtggcggcagagcctggcacaccattcagcattggccgcttcgccacgctcacactgcaggagcggcgggaccggggggcagagaaggagcacaagcgctaccacagcctgggcaacatcagccggggtggcagtggcggcagtggcagtggtggggagaagcccagcggccctgttccccgcagccgcctggaccccgccaaggtgctgggcactgcgctgtgcccgcgcatccacgaggtgcccctgctggagccccttgtgtgcaagaagatcgcccaggagcggctcacagtcctcctgttcctggaggactgcatcatcactgcctgccaggagggcctcatctgcacctgggcccggccgggcaaggcgttcacagacgaggagaccgaggcccagacaggggaaggaagttggcccaggtcacccagcaagtcagtggtagagggcatctcctcccaaccaggcaactccccgagtggcacagtggtgtgaagccatggatatcgggcccccccaaccccatgcccccagcctcctagccataaccctccctgctgacctcacagatcaacgtattaacaagactaaccatgatggatggactgctccagtccccccacctgcacaaaatttgggggccccccagactggcccggacacgggcgatgtaatagcccttgtggcctcagccttgtcccccacccactgccaagtacaatgacctcttcctctgaaacatcagtgttaccctcatccctgtccccagcatgtgactggtcactcctggggagagactccccgcccctgccacaagagccccaggtctgcagtgtgcccctcagttgagtgggcagggccgggggtggtccagccctcgcccggcccccaccccagctgcccttgctattgtctgtgcttttgaagagtgttaaattatggaagcccctcaggttcctccctgtcccgcaggacctcttatttatactaaagttccctgttttctcagcgggtctgtccccttcggaggagatgatgtagaggacctgtgtgtgtactctgtggttctaggcagtccgctttccccagaggaggagtgcaggcctgctcccagcccagcgcctcccaccccttttcatagcaggaaaagccggagcccagggagggaacggacctgcgagtcacacaactggtgacccacaccagcggctggagcaggaccctcttggggagaagagcatcctgcccgcagccagggcccctcatcaaagtcctcggtgttttttaaattatcagaactgcccaggaccacgtttcccaggccctgcccagctgggactcctcggtccttgcctcctagtttctcaggcctggccctctcaaggcccaggcaccccaggccggttggaggccccgacttccactctggagaaccgtccaccctggaaagaagagctcagattcctcttggctctcggagccgcagggagtgtgtcttcccgcgccaccctccaccccccgaaatgtttctgtttctaatcccagcctgggcaggaatgtggctccccggccaggggccaaggagctattttggggtctcgtttgcccagggagggcttggctccaccactttcctcccccagcctttgggcagcaggtcacccctgttcaggctctgagggtgccccctcctggtcctgtcctcaccaccccttccccacctcctgggaaaaaaaaaaaaaaaaaaaaaaaagctggtataaagcagagagcctgagggctaaatttaactgtccgagtcggaatccatctctgagtcacccaagaagctgccctggcctcccgtccccttcccaggcctcaacccctttctcccacccagccccaacccccagccctcaccccctagcccccagttctggagcttgtcgggagcaagggggtggttgctactgggtcactcagcctcaattggccctgtttcagcaatgggcaggttcttcttgaaattcatcacacctgtggcttcctctgtgctctacctttttattggggtgacagtgtgacagctgagattctccatgcattccccctactctagcactgaagggttctgaagggccctggaaggagggagcttggggggctggcttgtgaggggttaaggctgggaggcgggaggggggctggaccaaggggtggggagaaggggaggaggcctcggccggccgcagagagaagtggccagagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgtgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgccca

SEQ ID NO: 369567 - DNA, 6505 bp, Homo sapiens
cggctgcgggcggcagtccggcagtggcggggcccggggggcgcccaagatggcggcgggcggcgcggagggcggctcgggccccggcgccgccatgggggactgcgcggagattaagtcgcaattccgcacgcgcgagggtttctacaagctactcccgggcgacggcgccgctcgcaggtcgggtccggcttccgcccagactccggtgccgcctcagccaccgcagcccccgcccggccctgcctccgcctccggtcccggcgctgcaggccccgcgtcgtccccgccgcccgcaggccccggacccgggcccgccctgcccgccgtgcgcctcagcctcgtgcgcctcggggagccggacagcgccggggccggggagccgcccgccacgcccgcggggctgggctcggggggagaccgcgtctgcttcaacttgggccgtgagctctatttctacccaggctgctgtcgtcgtgggagccaacggtccattgacctcaacaagccaattgacaagcggatctacaagggcacccagcccacctgccacgatttcaaccagttcactgctgccaccgagaccatctcgctgctggtgggcttctcagcgggtcaagtgcagtacctggatctcatcaaaaaggacaccagcaagctgttcaatgaggagcggttgatcgacaagaccaaggtgacatatctgaagtggctgcctgagtcggagagcctgttcctggcatcacacgccagtggccacctgtacctgtacaacgtcagccacccctgcgcctcggccccgccccagtacagcctgctgaagcagggcgagggcttctctgtctatgctgccaagagcaaggcaccccgcaacccgctggccaagtgggcggtgggtgaggggcccctcaacgagttcgccttctcgcccgatggccggcacctggcctgtgtgagccaggatggctgcctgcgcgtcttccacttcgactccatgctcctgcgtgggctcatgaagagctactttgggggcctgctgtgtgtgtgctggagccctgacggccgctacgtggtgacgggtggcgaagatgacctggtcaccgtgtggtccttcaccgagggccgcgtggtggctcgaggccatggccacaagtcctgggtcaacgctgtggcctttgacccctacaccacaagggcagaggaggcggcgacagcagccggtgctgatggggagcggagcggcgaagaggaggaggaggagcccgaggctgcgggcacaggctcggccgggggcgccccgctctctccactgcccaaggctggctccattacttaccgctttggctcggcgggccaggacacgcagttctgcctgtgggacctcactgaagacgtgctctacccgcacccgcccctggcccgcacccgcaccctccctggcacacctggcaccacgccaccggccgccagcagctcgaggggtggcgagcctggcccaggccccctgcctcgctcgctgtcccgctccaacagtctcccgcacccagctggcgggggcaaggcgggcggcccgggtgtggcggcagagcctggcacaccattcagcattggccgcttcgccacgctcacactgcaggagcggcgggaccggggggcagagaaggagcacaagcgctaccacagcctgggcaacatcagccggggtggcagtggcggcagtggcagtggtggggagaagcccagcggccctgttccccgcagccgcctggaccccgccaaggtgctgggcactgcgctgtgcccgcgcatccacgaggtgcccctgctggagccccttgtgtgcaagaagatcgcccaggagcggctcacagtcctcctgttcctggaggactgcatcatcactgcctgccaggagggcctcatctgcacctgggcccggccgggcaaggcgttcacagacgaggagaccgaggcccagacaggggaaggaagttggcccaggtcacccagcaagtcagtggtagagggcatctcctcccaaccaggcaactccccgagtggcacagtggtgtgaagccatggatatcgggcccccccaaccccatgcccccagcctcctagccataaccctccctgctgacctcacagatcaacgtattaacaagactaaccatgatggatggactgctccagtccccccacctgcacaaaatttgggggccccccagactggcccggacacgggcgatgtaatagcccttgtggcctcagccttgtcccccacccactgccaagtacaatgacctcttcctctgaaacatcagtgttaccctcatccctgtccccagcatgtgactggtcactcctggggagagactccccgcccctgccacaagagccccaggtctgcagtgtgcccctcagttgagtgggcagggccgggggtggtccagccctcgcccggcccccaccccagctgcccttgctattgtctgtgcttttgaagagtgttaaattatggaagcccctcaggttcctccctgtcccgcaggacctcttatttatactaaagttccctgttttctcagcgggtctgtccccttcggaggagatgatgtagaggacctgtgtgtgtactctgtggttctaggcagtccgctttccccagaggaggagtgcaggcctgctcccagcccagcgcctcccaccccttttcatagcaggaaaagccggagcccagggagggaacggacctgcgagtcacacaactggtgacccacaccagcggctggagcaggaccctcttggggagaagagcatcctgcccgcagccagggcccctcatcaaagtcctcggtgttttttaaattatcagaactgcccaggaccacgtttcccaggccctgcccagctgggactcctcggtccttgcctcctagtttctcaggcctggccctctcaaggcccaggcaccccaggccggttggaggccccgacttccactcctccaccccccgaaatgtttctgtttctaatcccagcctgggcaggaatgtggctccccggccaggggccaaggagctattttggggtctcgtttgcccagggagggcttggctccaccactttcctcccccagcctttgggcagcaggtcacccctgttcaggctctgagggtgccccctcctggtcctgtcctcaccaccccttccccacctcctgggaaaaaaaaaaaaaaaaaaaaaaaagctggtataaagcagagagcctgagggctaaatttaactgtccgagtcggaatccatctctgagtcacccaagaagctgccctggcctcccgtccccttcccaggcctcaacccctttctcccacccagccccaacccccagccctcaccccctagcccccagttctggagcttgtcgggagcaagggggtggttgctactgggtcactcagcctcaattggccctgtttcagcaatgggcaggttcttcttgaaattcatcacacctgtggcttcctctgtgctctacctttttattggggtgacagtgtgacagctgagattctccatgcattccccctactctagcactgaagggttctgaagggccctggaaggagggagcttggggggctggcttgtgaggggttaaggctgggaggcgggaggggggctggaccaaggggtggggagaaggggaggaggcctcggccggccgcagagagaagtggccagagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgtgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgccca

SEQ ID NO: 369568 - DNA, 5234 bp, Homo sapiens
cggctgcgggcggcagtccggcagtggcggggcccggggggcgcccaagatggcggcgggcggcgcggagggcggctcgggccccggcgccgccatgggggactgcgcggagattaagtcgcaattccgcacgcgcgagggtttctacaagctactcccgggcgacggcgccgctcgcaggtcgggtccggcttccgcccagactccggtgccgcctcagccaccgcagcccccgcccggccctgcctccgcctccggtcccggcgctgcaggccccgcgtcgtccccgccgcccgcaggccccggacccgggcccgccctgcccgccgtgcgcctcagcctcgtgcgcctcggggagccggacagcgccggggccggggagccgcccgccacgcccgcggggctgggctcggggggagaccgcgtctgcttcaacttgggccgtgagctctatttctacccaggctgctgtcgtcgtgggagccaacggtccattgacctcaacaagccaattgacaagcggatctacaagggcacccagcccacctgccacgatttcaaccagttcactgctgccaccgagaccatctcgctgctggtgggcttctcagcgggtcaagtgcagtacctggatctcatcaaaaaggacaccagcaagctgttcaatgaggagcggttgatcgacaagaccaaggtgacatatctgaagtggctgcctgagtcggagagcctgttcctggcatcacacgccagtggccacctgtacctgtacaacgtcagccacccctgcgcctcggccccgccccagtacagcctgctgaagcagggcgagggcttctctgtctatgctgccaagagcaaggcaccccgcaacccgctggccaagtgggcggtgggtgaggggcccctcaacgagttcgccttctcgcccgatggccggcacctggcctgtgtgagccaggatggctgcctgcgcgtcttccacttcgactccatgctcctgcgtgggctcatgaagagctactttgggggcctgctgtgtgtgtgctggagccctgacggccgctacgtggtgacgggtggcgaagatgacctggtcaccgtgtggtccttcaccgagggccgcgtggtggctcgaggccatggccacaagtcctgggtcaacgctgtggcctttgacccctacaccacaagggcagaggaggcggcgacagcagccggtgctgatggggagcggagcggcgaagaggaggaggaggagcccgaggctgcgggcacaggctcggccgggggcgccccgctctctccactgcccaaggctggctccattacttaccgctttggctcggcgggccaggacacgcagttctgcctgtgggacctcactgaagacgtgctctacccgcacccgcccctggcccgcacccgcaccctccctggcacacctggcaccacgccaccggccgccagcagctcgaggggtggcgagcctggcccaggccccctgcctcgctcgctgtcccgctccaacagtctcccgcacccagctggcgggggcaaggcgggcggcccgggtgtggcggcagagcctggcacaccattcagcattggccgcttcgccacgctcacactgcaggagcggcgggaccggggggcagagaaggagcacaagcgctaccacagcctgggcaacatcagccggggtggcagtggcggcagtggcagtggtggggagaagcccagcggccctgttccccgcagccgcctggaccccgccaaggtgctgggcactgcgctgtgcccgcgcatccacgaggtgcccctgctggagccccttgtgtgcaagaagatcgcccaggagcggctcacagtcctcctgttcctggaggactgcatcatcactgcctgccaggagggcctcatctgcacctgggcccggccgggcaaggcgttcacagacgaggagaccgaggcccagacaggggaaggaagttggcccaggtcacccagcaagtcagtggtagagggcatctcctcccaaccaggcaactccccgagtggcacagtggtgtgaagccatggatatcgggcccccccaaccccatgcccccagcctcctagccataaccctccctgctgacctcacagatcaacgtattaacaagactaaccatgatggatggactgctccagtccccccacctgcacaaaatttgggggccccccagactggcccggacacgggcgatgtaatagcccttgtggcctcagccttgtcccccacccactgccaagtacaatgacctcttcctctgaaacatcagtgttaccctcatccctgtccccagcatgtgactggtcactcctggggagagactccccgcccctgccacaagagccccaggtctgcagtgtgcccctcagttgagtgggcagggccgggggtggtccagccctcgcccggcccccaccccagctgcccttgctattgtctgtgcttttgaagagtgttaaattatggaagcccctcaggttcctccctgtcccgcaggacctcttatttatactaaagttccctgttttctcagcgggtctgtccccttcggaggagatgatgtagaggacctgtgtgtgtactctgtggttctaggcagtccgctttccccagaggaggagtgcaggcctgctcccagcccagcgcctcccaccccttttcatagcaggaaaagccggagcccagggagggaacggacctgcgagtcacacaactggtgacccacaccagcggctggagcaggaccctcttggggagaagagcatcctgcccgcagccagggcccctcatcaaagtcctcggtgttttttaaattatcagaactgcccaggaccacgtttcccaggccctgcccagctgggactcctcggtccttgcctcctagtttctcaggcctggccctctcaaggcccaggcaccccaggccggttggaggccccgacttccactctggagaaccgtccaccctggaaagaagagctcagattcctcttggctctcggagccgcagggagtgtgtcttcccgcgccaccctccaccccccgaaatgtttctgtttctaatcccagcctgggcaggaatgtggctccccggccaggggccaaggagctattttggggtctcgtttgcccagggagggcttggctccaccactttcctcccccagcctttgggcagcaggtcacccctgttcaggctctgagggtgccccctcctggtcctgtcctcaccaccccttccccacctcctgggaaaaaaaaaaaaaaaaaaaaaaaagctggtataaagcagagagcctgagggctaaatttaactgtccgagtcggaatccatctctgagtcacccaagaagctgccctggcctcccgtccccttcccaggcctcaacccctttctcccacccagccccaacccccagccctcaccccctagcccccagttctggagcttgtcgggagcaagggggtggttgctactgggtcactcagcctcaattggccctgtttcagcaatgggcaggttcttcttgaaattcatcacacctgtggcttcctctgtgctctacctttttattggggtgacagtgtgacagctgagattctccatgcattccccctactctagcactgaagggttctgaagggccctggaaggagggagcttggggggctggcttgtgaggggttaaggctgggaggcgggaggggggctggaccaaggggtggggagaaggggaggaggcctcggccggccgcagagagaagtggccagagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgagtcccagccccacacccatgacttgatggt

SEQ ID NO: 369569 - DNA, 5042 bp, Homo sapiens
  misc_feature (1815)..(1815): n is a, c, g, or t
  misc_feature (1858)..(1858): n is a, c, g, or t
  misc_feature (1881)..(1881): n is a, c, g, or t
atataagaggcattgtcctctggaggctcgaatgaagcagtcagacatgctgctagagagaggggtgtctgctttttcaacgtgagagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatgtaagacccctctctttcccctgcctcagacctgctgcccattctgcagatcccctccctggctcctggtctccccgtccagatatagggctcaccctacgtctttgcgactttagagggcagaagccctttattcagccccagatctccctccgttcaggcctcaccagattccctccgggatctccctagataacctccccaacctcgattcccctcgctgtctctcgccccaccgctgagggctgggctgggctccgatcgggtcacctgtcccttctctctccagctagatggccccccggccgtggctgtgggccagtgcccgctggtggggccaggccccatgcaccgccgccacctgctgctccctgccagggtacgtccggctgcccacgcccccctccgccgtcgcgccccgcgctccacccgccccntgccacccgcttagctgcgcatttgcggggctgggcccacggnaggagggcggatcttcgggcagncaatcaacacaggccgctaggaagcagccaatgacgagttcggacgggattcgaggcgtgcgagtggactaacaacagctgtaggctgttggggcgggggcggggcgcagggaagagtgcgggcccacctatgggcgtaggcggggcgagtcccaggagccaatcagaggcccatgccgggtgttgacctcgccctctccccgcaggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgtgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgcccaaagctctggactccacagtgtccgcggtttgcgttgtgggccggaggctccgcagcgggccaatccggaggcgtgtggaggcggccgaaggtctgggaggagctagcgggatgcgaagcggccgaatcagggttgggggaggaaaagccacggggcggggctttggcgtccggccaataggagggcgagcgggccacccggaggcaccgcccccgcccagctgtggcccagctgtgccaccgagcgtcgagaagagggggctgggctggcagcgcgcgcggccatcctccttccactgcgcctgcgcacgccacgcgcatccgctcctgggacgcaagctcgagaaaagttgctgcaaactttctagcccgttccccgcccctcctcccggccagacccgccccccctgcggagccgggaattccgaggggcggagcgcaggccgagatggggaatgtgggggcctgcagaggaccctggagacggaggcgtgcagaagctcagtctcggggcggaggcttcgcgcccttagtcctcctggacggcccgttaccttctgcgttgtcccgatggggaaactgaggccctgagccagaagcacacgctggggggaggcagaaagcgcggccagaggcggagggaaaacaaagggagaatcacagacagacgggagggggacggacacacacaaggggacagagacccgagtggagagctggatctcgccttcccggcgtggggcgcagggtcggccagaaagaagatcgagaagagcggggagtgggggcgaaaaggggggacaggtgggggaggaggctggggaaagcccgagggaggaagagagggagggaggaacttcccaaagttgcaaaacatggctaccttgccactgaagccagagacggccatctccgtgcctgagggaggcctcccggtggcccccagccctgctctcccagaggctcacgccctaggcaccctttctgcacagcagccaccccccgccgctgccaccacctccagcaccagcctgcccttctcccctgactcccctggcctcctgcccaacttcccggcgcccccaccagaggggctgatgttgtcacccgcggccgtgcctgtctggtcagcagggctggaactaagcgcaggaacagaggggctgctggaagcggaaaaggggctggggacacaggccccccacaccatgctgaggctgccagaccccgaccctgaggggctgctcctgggggccaccgcagggggtgaggttgacgaggggttggaagctgaggccaaggttctgacccagctccagtcggtgcctgtggaggagcccttggaactgtgacccagtgtggccccgtggcctctcccgacattggtgctgaagacgcagggacaggaatgggaggggggagccccagaaatgcggttgctgaagaccccagtcaccacatccttctgcctgggtggcctctccaagccctggtggtgctgggggttgtatccccggccacctcctgtccaggtctccatccccctttggatgggaggcctctctgttacagccctccccatgctgtgccctgccatatacgtgggggactcagggtcctgactcaggggccctgccccctccacttggtactagctgtaagcggaacaccctgccccagggccggacttccagcccccagagccctctccctgtcactccctgaaacactattaatagctctgccgatagctggtgttgtcacaactgcctggaatccgaaggtggaggacaggcagccccgcgcccctgagactggagaccctccccagtgtggcatttcctgccaggggcggggggtggggcagctgtggggagacgggggtcttccttcaccagctcccctcgactcaagcccttgtcctcattatccggcccagaccaaagattccctcatccctgggggcagccctgccgctgtgtctcctttgtatcctaaatctttatttttctaggacatgttatgcctccattttcaattaaaataaagttatcggattacaccacca

SEQ ID NO: 369570 - DNA, 3039 bp, Homo sapiens
ggtcctcactatgtctgtgagctctgcaacaaaggcttcaccacggcagcatacctgcgtattcacgcggtgaaggaccacaaggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgtgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgcccaaagctctggactccacagtgtccgcggtttgcgttgtgggccggaggctccgcagcgggccaatccggaggcgtgtggaggcggccgaaggtctgggaggagctagcgggatgcgaagcggccgaatcagggttgggggaggaaaagccacggggcggggctttggcgtccggccaataggagggcgagcgggccacccggaggcaccgcccccgcccagctgtggcccagctgtgccaccgagcgtcgagaagagggggctgggctggcagcgcgcgcggccatcctccttccactgcgcctgcgcacgccacgcgcatccgctcctgggacgcaagctcgagaaaagttgctgcaaactttctagcccgttccccgcccctcctcccggccagacccgccccccctgcggagccgggaattccgaggggcggagcgcaggccgagatggggaatgtgggggcctgcagaggaccctggagacggaggcgtgcagaagctcagtctcggggcggaggcttcgcgcccttagtcctcctggacggcccgttaccttctgcgttgtcccgatggggaaactgaggccctgagccagaagcacacgctggggggaggcagaaagcgcggccagaggcggagggaaaacaaagggagaatcacagacagacgggagggggacggacacacacaaggggacagagacccgagtggagagctggatctcgccttcccggcgtggggcgcagggtcggccagaaagaagatcgagaagagcggggagtgggggcgaaaaggggggacaggtgggggaggaggctggggaaagcccgagggaggaagagagggagggaggaacttcccaaagttgcaaaacatggctaccttgccactgaagccagagacggccatctccgtgcctgagggaggcctcccggtggcccccagccctgctctcccagaggctcacgccctaggcaccctttctgcacagcagccaccccccgccgctgccaccacctccagcaccagcctgcccttctcccctgactcccctggcctcctgcccaacttcccggcgcccccaccagaggggctgatgttgtcacccgcggccgtgcctgtctggtcagcagggctggaactaagcgcaggaacagaggggctgctggaagcggaaaaggggctggggacacaggccccccacaccatgctgaggctgccagaccccgaccctgaggggctgctcctgggggccaccgcagggggtgaggttgacgaggggttggaagctgaggccaaggttctgacccagctccagtcggtgcctgtggaggagcccttggaactgtgacccagtgtggccccgtggcctctcccgacattggtgctgaagacgcagggacaggaatgggaggggggagccccagaaatgcggttgctgaagaccccagtcaccacatccttctgcctgggtggcctctccaagccctggtggtgctgggggttgtatccccggccacctcctgtccaggtctccatccccctttggatgggaggcctctctgttacagccctccccatgctgtgccctgccatatacgtgggggactcagggtcctgactcaggggccctgccccctccacttggtactagctgtaagcggaacaccctgccccagggccggacttccagcccccagagccctctccctgtcactccctgaaacactattaatagctctgccgatagctggtgttgtcacaactgcctggaatccgaaggtggaggacaggcagccccgcgcccctgagactggagaccctccccagtgtggcatttcctgccaggggcggggggtggggcagctgtggggagacgggggtcttccttcaccagctcccctcgactcaagcccttgtcctcattatccggcccagaccaaagattccctcatccctgggggcagccctgccgctgtgtctcctttgtatcctaaatctttatttttctaggacatgttatgcctccattttcaattaaaataaagttatcggattacaccacca

SEQ ID NO: 369571 - DNA, 187 bp, Homo sapiens
gcctatgaaatgttctatgggcagacgcccttctacgcggattccacggcggagacctatggcaagatcgtccactacaaggtgagcacggccgcagggagacctggcctctcccggtaggcgctcccaggctatcgcctcctctccctctgagcaggagcacctctctctgccgctggtggacgaa

SEQ ID NO: 369572 - DNA, 8696 bp, Homo sapiens
cggctgcgggcggcagtccggcagtggcggggcccggggggcgcccaagatggcggcgggcggcgcggagggcggctcgggccccggcgccgccatgggggactgcgcggagattaagtcgcaattccgcacgcgcgagggtttctacaagctactcccgggcgacggcgccgctcgcaggtcgggtccggcttccgcccagactccggtgccgcctcagccaccgcagcccccgcccggccctgcctccgcctccggtcccggcgctgcaggccccgcgtcgtccccgccgcccgcaggccccggacccgggcccgccctgcccgccgtgcgcctcagcctcgtgcgcctcggggagccggacagcgccggggccggggagccgcccgccacgcccgcggggctgggctcggggggagaccgcgtctgcttcaacttgggccgtgagctctatttctacccaggctgctgtcgtcgtgggagccaacggtccattgacctcaacaagccaattgacaagcggatctacaagggcacccagcccacctgccacgatttcaaccagttcactgctgccaccgagaccatctcgctgctggtgggcttctcagcgggtcaagtgcagtacctggatctcatcaaaaaggacaccagcaagctgttcaatgaggagcggttgatcgacaagaccaaggtgacatatctgaagtggctgcctgagtcggagagcctgttcctggcatcacacgccagtggccacctgtacctgtacaacgtcagccacccctgcgcctcggccccgccccagtacagcctgctgaagcagggcgagggcttctctgtctatgctgccaagagcaaggcaccccgcaacccgctggccaagtgggcggtgggtgaggggcccctcaacgagttcgccttctcgcccgatggccggcacctggcctgtgtgagccaggatggctgcctgcgcgtcttccacttcgactccatgctcctgcgtgggctcatgaagagctactttgggggcctgctgtgtgtgtgctggagccctgacggccgctacgtggtgacgggtggcgaagatgacctggtcaccgtgtggtccttcaccgagggccgcgtggtggctcgaggccatggccacaagtcctgggtcaacgctgtggcctttgacccctacaccacaagggcagaggaggcggcgacagcagccggtgctgatggggagcggagcggcgaagaggaggaggaggagcccgaggctgcgggcacaggctcggccgggggcgccccgctctctccactgcccaaggctggctccattacttaccgctttggctcggcgggccaggacacgcagttctgcctgtgggacctcactgaagacgtgctctacccgcacccgcccctggcccgcacccgcaccctccctggcacacctggcaccacgccaccggccgccagcagctcgaggggtggcgagcctggcccaggccccctgcctcgctcgctgtcccgctccaacagtctcccgcacccagctggcgggggcaaggcgggcggcccgggtgtggcggcagagcctggcacaccattcagcattggccgcttcgccacgctcacactgcaggagcggcgggaccggggggcagagaaggagcacaagcgctaccacagcctgggcaacatcagccggggtggcagtggcggcagtggcagtggtggggagaagcccagcggccctgttccccgcagccgcctggaccccgccaaggtgctgggcactgcgctgtgcccgcgcatccacgaggtgcccctgctggagccccttgtgtgcaagaagatcgcccaggagcggctcacagtcctcctgttcctggaggactgcatcatcactgcctgccaggagggcctcatctgcacctgggcccggccgggcaaggcgttcacagacgaggagaccgaggcccagacaggggaaggaagttggcccaggtcacccagcaagtcagtggtagagggcatctcctcccaaccaggcaactccccgagtggcacagtggtgtgaagccatggatatcgggcccccccaaccccatgcccccagcctcctagccataaccctccctgctgacctcacagatcaacgtattaacaagactaaccatgatggatggactgctccagtccccccacctgcacaaaatttgggggccccccagactggcccggacacgggcgatgtaatagcccttgtggcctcagccttgtcccccacccactgccaagtacaatgacctcttcctctgaaacatcagtgttaccctcatccctgtccccagcatgtgactggtcactcctggggagagactccccgcccctgccacaagagccccaggtctgcagtgtgcccctcagttgagtgggcagggccgggggtggtccagccctcgcccggcccccaccccagctgcccttgctattgtctgtgcttttgaagagtgttaaattatggaagcccctcaggttcctccctgtcccgcaggacctcttatttatactaaagttccctgttttctcagcgggtctgtccccttcggaggagatgatgtagaggacctgtgtgtgtactctgtggttctaggcagtccgctttccccagaggaggagtgcaggcctgctcccagcccagcgcctcccaccccttttcatagcaggaaaagccggagcccagggagggaacggacctgcgagtcacacaactggtgacccacaccagcggctggagcaggaccctcttggggagaagagcatcctgcccgcagccagggcccctcatcaaagtcctcggtgttttttaaattatcagaactgcccaggaccacgtttcccaggccctgcccagctgggactcctcggtccttgcctcctagtttctcaggcctggccctctcaaggcccaggcaccccaggccggttggaggccccgacttccactctggagaaccgtccaccctggaaagaagagctcagattcctcttggctctcggagccgcagggagtgtgtcttcccgcgccaccctccaccccccgaaatgtttctgtttctaatcccagcctgggcaggaatgtggctccccggccaggggccaaggagctattttggggtctcgtttgcccagggagggcttggctccaccactttcctcccccagcctttgggcagcaggtcacccctgttcaggctctgagggtgccccctcctggtcctgtcctcaccaccccttccccacctcctgggaaaaaaaaaaaaaaaaaaaaaaaagctggtataaagcagagagcctgagggctaaatttaactgtccgagtcggaatccatctctgagtcacccaagaagctgccctggcctcccgtccccttcccaggcctcaacccctttctcccacccagccccaacccccagccctcaccccctagcccccagttctggagcttgtcgggagcaagggggtggttgctactgggtcactcagcctcaattggccctgtttcagcaatgggcaggttcttcttgaaattcatcacacctgtggcttcctctgtgctctacctttttattggggtgacagtgtgacagctgagattctccatgcattccccctactctagcactgaagggttctgaagggccctggaaggagggagcttggggggctggcttgtgaggggttaaggctgggaggcgggaggggggctggaccaaggggtggggagaaggggaggaggcctcggccggccgcagagagaagtggccagagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgtgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgcccaaagctctggactccacagtgtccgcggtttgcgttgtgggccggaggctccgcagcgggccaatccggaggcgtgtggaggcggccgaaggtctgggaggagctagcgggatgcgaagcggccgaatcagggttgggggaggaaaagccacggggcggggctttggcgtccggccaataggagggcgagcgggccacccggaggcaccgcccccgcccagctgtggcccagctgtgccaccgagcgtcgagaagagggggctgggctggcagcgcgcgcggccatcctccttccactgcgcctgcgcacgccacgcgcatccgctcctgggacgcaagctcgagaaaagttgctgcaaactttctagcccgttccccgcccctcctcccggccagacccgccccccctgcggagccgggaattccgaggggcggagcgcaggccgagatggggaatgtgggggcctgcagaggaccctggagacggaggcgtgcagaagctcagtctcggggcggaggcttcgcgcccttagtcctcctggacggcccgttaccttctgcgttgtcccgatggggaaactgaggccctgagccagaagcacacgctggggggaggcagaaagcgcggccagaggcggagggaaaacaaagggagaatcacagacagacgggagggggacggacacacacaaggggacagagacccgagtggagagctggatctcgccttcccggcgtggggcgcagggtcggccagaaagaagatcgagaagagcggggagtgggggcgaaaaggggggacaggtgggggaggaggctggggaaagcccgagggaggaagagagggagggaggaacttcccaaagttgcaaaacatggctaccttgccactgaagccagagacggccatctccgtgcctgagggaggcctcccggtggcccccagccctgctctcccagaggctcacgccctaggcaccctttctgcacagcagccaccccccgccgctgccaccacctccagcaccagcctgcccttctcccctgactcccctggcctcctgcccaacttcccggcgcccccaccagaggggctgatgttgtcacccgcggccgtgcctgtctggtcagcagggctggaactaagcgcaggaacagaggggctgctggaagcggaaaaggggctggggacacaggccccccacaccatgctgaggctgccagaccccgaccctgaggggctgctcctgggggccaccgcagggggtgaggttgacgaggggttggaagctgaggccaaggttctgacccagctccagtcggtgcctgtggaggagcccttggaactgtgacccagtgtggccccgtggcctctcccgacattggtgctgaagacgcagggacaggaatgggaggggggagccccagaaatgcggttgctgaagaccccagtcaccacatccttctgcctgggtggcctctccaagccctggtggtgctgggggttgtatccccggccacctcctgtccaggtctccatccccctttggatgggaggcctctctgttacagccctccccatgctgtgccctgccatatacgtgggggactcagggtcctgactcaggggccctgccccctccacttggtactagctgtaagcggaacaccctgccccagggccggacttccagcccccagagccctctccctgtcactccctgaaacactattaatagctctgccgatagctggtgttgtcacaactgcctggaatccgaaggtggaggacaggcagccccgcgcccctgagactggagaccctccccagtgtggcatttcctgccaggggcggggggtggggcagctgtggggagacgggggtcttccttcaccagctcccctcgactcaagcccttgtcctcattatccggcccagaccaaagattccctcatccctgggggcagccctgccgctgtgtctcctttgtatcctaaatctttatttttctaggacatgttatgcctccattttcaattaaaataaagttatcggattacaccaccaccaggggtctggggtgccttccagtgtctgtccaaagcagc

SEQ ID NO: 369573 - DNA, 8538 bp, Homo sapiens
cggctgcgggcggcagtccggcagtggcggggcccggggggcgcccaagatggcggcgggcggcgcggagggcggctcgggccccggcgccgccatgggggactgcgcggagattaagtcgcaattccgcacgcgcgagggtttctacaagctactcccgggcgacggcgccgctcgcaggtcgggtccggcttccgcccagactccggtgccgcctcagccaccgcagcccccgcccggccctgcctccgcctccggtcccggcgctgcaggccccgcgtcgtccccgccgcccgcaggccccggacccgggcccgccctgcccgccgtgcgcctcagcctcgtgcgcctcggggagccggacagcgccggggccggggagccgcccgccacgcccgcggggctgggctcggggggagaccgcgtctgcttcaacttgggccgtgagctctatttctacccaggctgctgtcgtcgtgggagccaacggtccattgacctcaacaagccaattgacaagcggatctacaagggcacccagcccacctgccacgatttcaaccagttcactgctgccaccgagaccatctcgctgctggtgggcttctcagcgggtcaagtgcagtacctggatctcatcaaaaaggacaccagcaagctgttcaatgaggagcggttgatcgacaagaccaaggtgacatatctgaagtggctgcctgagtcggagagcctgttcctggcatcacacgccagtggccacctgtacctgtacaacgtcagccacccctgcgcctcggccccgccccagtacagcctgctgaagcagggcgagggcttctctgtctatgctgccaagagcaaggcaccccgcaacccgctggccaagtgggcggtgggtgaggggcccctcaacgagttcgccttctcgcccgatggccggcacctggcctgtgtgagccaggatggctgcctgcgcgtcttccacttcgactccatgctcctgcgtgggctcatgaagagctactttgggggcctgctgtgtgtgtgctggagccctgacggccgctacgtggtgacgggtggcgaagatgacctggtcaccgtgtggtccttcaccgagggccgcgtggtggctcgaggccatggccacaagtcctgggtcaacgctgtggcctttgacccctacaccacaagggcagaggaggcggcgacagcagccggtgctgatggggagcggagcggcgaagaggaggaggaggagcccgaggctgcgggcacaggctcggccgggggcgccccgctctctccactgcccaaggctggctccattacttaccgctttggctcggcgggccaggacacgcagttctgcctgtgggacctcactgaagacgtgctctacccgcacccgcccctggcccgcacccgcaccctccctggcacacctggcaccacgccaccggccgccagcagctcgaggggtggcgagcctggcccaggccccctgcctcgctcgctgtcccgctccaacagtctcccgcacccagctggcgggggcaaggcgggcggcccgggtgtggcggcagagcctggcacaccattcagcattggccgcttcgccacgctcacactgcaggagcggcgggaccggggggcagagaaggagcacaagcgctaccacagcctgggcaacatcagccggggtggcagtggcggcagtggcagtggtggggagaagcccagcggccctgttccccgcagccgcctggaccccgccaaggtgctgggcactgcgctgtgcccgcgcatccacgaggtgcccctgctggagccccttgtgtgcaagaagatcgcccaggagcggctcacagtcctcctgttcctggaggactgcatcatcactgcctgccaggagggcctcatctgcacctgggcccggccgggcaaggcgttcacagacgaggagaccgaggcccagacaggggaaggaagttggcccaggtcacccagcaagtcagtggtagagggcatctcctcccaaccaggcaactccccgagtggcacagtggtgtgaagccatggatatcgggcccccccaaccccatgcccccagcctcctagccataaccctccctgctgacctcacagatcaacgtattaacaagactaaccatgatggatggactgctccagtccccccacctgcacaaaatttgggggccccccagactggcccggacacgggcgatgtaatagcccttgtggcctcagccttgtcccccacccactgccaagtacaatgacctcttcctctgaaacatcagtgttaccctcatccctgtccccagcatgtgactggtcactcctggggagagactccccgcccctgccacaagagccccaggtctgcagtgtgcccctcagttgagtgggcagggccgggggtggtccagccctcgcccggcccccaccccagctgcccttgctattgtctgtgcttttgaagagtgttaaattatggaagcccctcaggttcctccctgtcccgcaggacctcttatttatactaaagttccctgttttctcagcgggtctgtccccttcggaggagatgatgtagaggacctgtgtgtgtactctgtggttctaggcagtccgctttccccagaggaggagtgcaggcctgctcccagcccagcgcctcccaccccttttcatagcaggaaaagccggagcccagggagggaacggacctgcgagtcacacaactggtgacccacaccagcggctggagcaggaccctcttggggagaagagcatcctgcccgcagccagggcccctcatcaaagtcctcggtgttttttaaattatcagaactgcccaggaccacgtttcccaggccctgcccagctgggactcctcggtccttgcctcctagtttctcaggcctggccctctcaaggcccaggcaccccaggccggttggaggccccgacttccactctggagaaccgtccaccctggaaagaagagctcagattcctcttggctctcggagccgcagggagtgtgtcttcccgcgccaccctccaccccccgaaatgtttctgtttctaatcccagcctgggcaggaatgtggctccccggccaggggccaaggagctattttggggtctcgtttgcccagggagggcttggctccaccactttcctcccccagcctttgggcagcaggtcacccctgttcaggctctgagggtgccccctcctggtcctgtcctcaccaccccttccccacctcctgggaaaaaaaaaaaaaaaaaaaaaaaagctggtataaagcagagagcctgagggctaaatttaactgtccgagtcggaatccatctctgagtcacccaagaagctgccctggcctcccgtccccttcccaggcctcaacccctttctcccacccagccccaacccccagccctcaccccctagcccccagttctggagcttgtcgggagcaagggggtggttgctactgggtcactcagcctcaattggccctgtttcagcaatgggcaggttcttcttgaaattcatcacacctgtggcttcctctgtgctctacctttttattggggtgacagtgtgacagctgagattctccatgcattccccctactctagcactgaagggttctgaagggccctggaaggagggagcttggggggctggcttgtgaggggttaaggctgggaggcgggaggggggctggaccaaggggtggggagaaggggaggaggcctcggccggccgcagagagaagtggccagagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgtgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgcccaaagctctggactccacagtgtccgcggtttgcgttgtgggccggaggctccgcagcgggccaatccggaggcgtgtggaggcggccgaaggtctgggaggagctagcgggatgcgaagcggccgaatcagggttgggggaggaaaagccacggggcggggctttggcgtccggccaataggagggcgagcgggccacccggaggcaccgcccccgcccagctgtggcccagctgtgccaccgagcgtcgagaagagggggctgggctggcagcgcgcgcggccatcctccttccactgcgcctgcgcacgccacgcgcatccgctcctgggacgcaagctcgagaaaagttgctgcaaactttctagcccgttccccgcccctcctcccggccagacccgccccccctgcggagccgggaattccgaggggcggagcgcaggccgagatggggaatgtgggggcctgcagaggaccctggagacggaggcgtgcagaagctcagtctcggggcggaggcttcgcgcccttagtcctcctggacggcccgttaccttctgcgttgtcccgatggggaaactgaggccctgagccagaagcacacgctggggggaggcagaaagcgcggccagaggcggagggaaaacaaagggagaatcacagacagacgggagggggacggacacacacaaggggacagagacccgagtggagagctggatctcgccttcccggcgtggggcgcagggtcggccagaaagaagatcgagaagagcggggagtgggggcgaaaaggggggacaggtgggggaggaggctggggaaagcccgagggaggaagagagggagggaggaacttcccaaagttgcaaaacatggctaccttgcctgcggagccgagcgcggggccggcggctgggggggaggcggtggcggcggcggcggcgaccgaagaggaggaggaggaagcgcgccagctcttgcagactttgcaggcggccgagggtgaggcggcggcggcggccggggccggggcgggcgcagcggctgcgggagctgagggcccgggatccccgggcgtccccgggtcgccccccgaggccgcttccgaaccgcccacgggcctccgcttctcgcccgagcaggtggcgtgcgtctgcgaggcgctgctccaggcgggccacgccggccgcttgagccgcttcctgggcgcactgcccccggccgagcgcctacgtggcagcgacccggtgttgcgcgcgcgggccctggtggccttccagcggggcgagtacgccgagctctaccggctactcgagagccgccccttccccgccgcccaccacgccttcctgcaggacctctacctgcgcgcgcgctaccatgaggccgagcgggcccgcggccgcgcgcttggcgcagtggacaagtatcgactgcgcaagaagttcccgctgcccaagaccatctgggacggcgaggagacagtctactgcttcaaggagcgctcccgcgcagcgctcaaggcctgctaccgcggcaaccgctaccccacgccggacgagaagcgccgcctggccacactcaccggcctgtcgctcacgcaggtcagcaactggttcaagaaccggcgacagcgcgaccggaccggggccggaggcggcgcgccctgcaagaggtgaggggcctcgggcggcgcaagtccagctctcccggggacatcccgtccaccagccctcttcccccgtgcccactgctggggccggcgcgccgaggtcctcggacatctcccgggaccagctcacaatctcaggcgcccgcggggcgcggggactaagtgtggacgggacaggcacccgcccgggccctctccccgcacgcgtctcctcttccagcggctccattccgagctccttcccaaatcccatcggtgttggggaatcacactgcg

SEQ ID NO: 369574 - DNA, 612 bp, Homo sapiens
agttgttttttgttttttgttttttttttaatttttttttgagatgggaagaacttgggtcctccttgctccacccaccctgcatggtgagaatggtggagcaggaaaggcaaaggggacctgatggagtgtctctcctgccagggctccctccttccggctgccacccgatcccagcttgccctgcatcctggtgggtccaggcactggcattgcccccttccggggattctggcaggagcggctgcatgacattgagagcaaaggtgaggctggggactaaaggactgcctgaagggagtcacacaatctagggacagaggggtggggctggaaggcaggaaataggaaagagagggcaggaaacaaagtccacaaagctgaaaagacgctcatgagaccaaggggagggcaggtaccaaaggcaagggctgggccctgagcttctggcttcctgtggcacaatctcggctcactgcaacctccgcctcccaagttcaagtgattcttctgcttcagcctcctgagtagctgagactacaggtgtgtgccaccacacccagctaattttttgtatttttagtagagatggggtttcaccatgttggccag

SEQ ID NO: 369575 - DNA, 591 bp, Homo sapiens
ctaactcctgggttcaagcaatccacctgcctcggcctcccaaagtgctgcgattatagacgtgagccactgcacctggccctcagtatcttaagcaagttggaatctcgtgaaaccctttttgctgccttagtgtccgtttcagccctcattctgacctaccttttcaagaaaaatagcaccagcaattgacttttttttagcataaaggtgtatagacacccatataacctacagccttcacaaggcatagcacattttcaccaccctggaaagttccctcatcagttcctcacgtgaatcccttcccagtctgtctccctgccagaagtgtctgtcaccacagaatagtttcgcctgctctagaacggcacctagatggaagcacgcagtgttgcggcgtctcctgctgaggctgtttttgaggcgcactcgtgttgctgcgtgactcagtatttcactcattctgctgctgagtgccgttcattgtgtgaatatccccagtttgtttacccattctcttgttggtgacacttgggctgtttccaggtcggggctattatgaataaacctgttatgaacattcttgta

SEQ ID NO: 369576 - DNA, 4076 bp, Homo sapiens
  misc_feature (4)..(6): n is a, c, g, or t
  misc_feature (18)..(19): n is a, c, g, or t
  misc_feature (22)..(23): n is a, c, g, or t
  misc_feature (31)..(31): n is a, c, g, or t
gaannnccactctgctgnngcnncagcaganggacgcacagtaacatgggcaacttgaagagcgtggcccaggagcctgggccaccctgcggcctggggctggggctgggccttgggctgtgcggcaagcagggcccagccaccccggcccctgagcccagccgggccccagcatccctactcccaccagcgccagaacacagccccccgagctccccgctaacccagcccccagaggggcccaagttccctcgtgtgaagaactgggaggtggggagcatcacctatgacaccctcagcgcccaggcgcagcaggatgggccctgcaccccaagacgctgcctgggctccctggtatttccacggaaactacagggccggccctcccccggccccccggcccctgagcagctgctgagtcaggcccgggacttcatcaaccagtactacagctccattaagaggagcggctcccaggcccacgaacagcggcttcaagaggtggaagccgaggtggcagccacaggcacctaccagcttagggagagcgagctggtgttcggggctaagcaggcctggcgcaacgctccccgctgcgtgggccggatccagtgggggaagctgcaggtgttcgatgcccgggactgcaggtctgcacaggaaatgttcacctacatctgcaaccacatcaagtatgccaccaaccggggcaaccttcgctcggccatcacagtgttcccgcagcgctgccctggccgaggagacttccgaatctggaacagccagctggtgcgctacgcgggctaccggcagcaggacggctctgtgcggggggacccagccaacgtggagatcaccgagctctgcattcagcacggctggaccccaggaaacggtcgcttcgacgtgctgcccctgctgctgcaggccccagatgagcccccagaactcttccttctgccccccgagctggtccttgaggtgcccctggagcaccccacgctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggatgtggctgtctgcatggacctggatacccggaccacctcgtccctgtggaaagacaaggcagcagtggaaatcaacgtggccgtgctgcacagttaccagctagccaaagtcaccatcgtggaccaccacgccgccacggcctctttcatgaagcacctggagaatgagcagaaggccagggggggctgccctgcagactgggcctggatcgtgccccccatctcgggcagcctcactcctgttttccatcaggagatggtcaactatttcctgtccccggccttccgctaccagccagacccctggaaggggagtgccgccaagggcaccggcatcaccaggaagaagacctttaaagaagtggccaacgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtcctgtgtatggatgagtatgacgtggtgtccctcgaacacgagacgctggtgctggtggtaaccagcacatttgggaatggggatcccccggagaatggagagagctttgcagctgccctgatggagatgtccggcccctacaacagctcccctcggccggaacagcacaagagttataagatccgcttcaacagcatctcctgctcagacccactggtgtcctcttggcggcggaagaggaaggagtccagtaacacagacagtgcaggggccctgggcaccctcaggttctgtgtgttcgggctcggctcccgggcatacccccacttctgcgcctttgctcgtgccgtggacacacggctggaggaactgggcggggagcggctgctgcagctgggccagggcgacgagctgtgcggccaggaggaggccttccgaggctgggcccaggctgccttccaggccgcctgtgagaccttctgtgtgggagaggatgccaaggccgccgcccgagacatcttcagccccaaacggagctggaagcgccagaggtaccggctgagcgcccaggccgagggcctgcagttgctgccaggtctgatccacgtgcacaggcggaagatgttccaggctacaatccgctcagtggaaaacctgcaaagcagcaagtccacgagggccaccatcctggtgcgcctggacaccggaggccaggaggggctgcagtaccagccgggggaccacataggtgtctgcccgcccaaccggcccggccttgtggaggcgctgctgagccgcgtggaggacccgccggcgcccactgagcccgtggcagtagagcagctggagaagggcagccctggtggccctccccccggctgggtgcgggacccccggctgcccccgtgcacgctgcgccaggctctcaccttcttcctggacatcacctccccacccagccctcagctcttgcggctgctcagcaccttggcagaagagcccagggaacagcaggagctggaggccctcagccaggatccccgacgctacgaggagtggaagtggttccgctgccccacgctgctggaggtgctggagcagttcccgtcggtggcgctgcctgccccactgctcctcacccagctgcctctgctccagccccggtactactcagtcagctcggcacccagcacccacccaggagagatccacctcactgtagctgtgctggcatacaggactcaggatgggctgggccccctgcactatggagtctgctccacgtggctaagccagctcaagcccggagaccctgtgccctgcttcatccggggggctccctccttccggctgccacccgatcccagcttgccctgcatcctggtgggtccaggcactggcattgcccccttccggggattctggcaggagcggctgcatgacattgagagcaaagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaagacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcccgaccaggatcagccccgctcctcccctcttgaggtggtgccttctcacatctgtccagaggctgcaaggattcagcattattcctccaggaaggagcaaaacgcctcttttccctctctaggcctgttgcctcgggcctgggtccgccttaatctggaaggcccctcccagcagcggtaccccagggcctactgccacccgcttcctgtttcttagtcgaatgttagattcctcttgcctctctcaggagtatcttacctgtaaagtctaatctctaaatcaagtatttattattgaagatttaccataagggactgtgccagatgttaggagaactactaaagtgcctaccccagctca

SEQ ID NO: 369577 - DNA, 264 bp, Homo sapiens
  misc_feature (260)..(260): n is a, c, g, or t
  misc_feature (263)..(263): n is a, c, g, or t
agttgttttttgttttttgttttttttttaatttttttttgagatgggaagaacttgggtcctccttgctccacccaccctgcatggtgagaatggtggagcaggaaaggcaaaggggacctgatggagtgtctctcctgccagggctccctccttccggctgccacccgatcccagcttgccctgcatcctggtgggtccaggcactggcattgcccccttctgtcgtcttctagcagcggaagagaagaagaagcccnccnc

SEQ ID NO: 369578 - DNA, 1978 bp, Homo sapiens
agttgttttttgttttttgttttttttttaatttttttttgagatgggaagaacttgggtcctccttgctccacccaccctgcatggtgagaatggtggagcaggaaaggcaaaggggacctgatggagtgtctctcctgccagggctccctccttccggctgccacccgatcccagcttgccctgcatcctggtgggtccaggcactggcattgcccccttccggggattctggcaggagcggctgcatgacattgagagcaaaggtgaggctggggactaaaggactgcctgaagggagtcacacaatctagggacagaggggtggggctggaaggcaggaaataggaaagagagggcaggaaacaaagtccacaaagctgaaaagacgctcatgagaccaaggggagggcaggtaccaaaggcaagggctgggccctgagcttctggcttcctggtgcctggtacatagtaggtgttgactggattgaggacaaaggaaaatagaattttcaaagggattagggctaagactcaaagaagaactgcccaaggtggattcttgactgtgccagagctgaccgaggtctgtccaagacctaaggatgctacaaggtgttcatattgagcatggggtgcccagggtggtctgtcaatcaaaagaagagggctgtgactgggaggagagttataagtatgggagaatatgaagtgggagcggggaaggggactgcgatgtcacacaatgcaaagggcatggaattctgagtccgaagccgcgcattctagcgcagctccaccaggggccaccacctcacccgcgcttcccttccctctgtaaatcagggctgtgcagggtctctgtgaaagcattctacactctcttagagatgaaacagccaaagtaatggtggtttcagcccaaaacgctgggctgccaggctgggcgacggtggcctgtggggaggccccactagcactgtgccccggagaagagccttcccaagcgcggggttgcttgcagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaaggtgtgagaccctgagggcgcaatggtaacacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcccgaccaggatcagccccgctcctcccctcttgaggtggtgccttctcacatctgtccagaggctgcaaggattcagcattattcctccaggaaggagcaaaacgcctcttttccctctctaggcctgttgcctcgggcctgggtccgccttaatctggaaggcccctcccagcagcggtaccccagggcctactgccacccgcttcctgtttcttagtcgaatgttagattcctcttgcctctctcaggagtatcttacctgtaaagtctaatctctaaatcaagtatttattattgaagatttaccataagggactgtgccagatgttaggagaactactaaagtgcctaccccagctca

SEQ ID NO: 369579 - DNA, 2067 bp, Homo sapiens
agttgttttttgttttttgttttttttttaatttttttttgagatgggaagaacttgggtcctccttgctccacccaccctgcatggtgagaatggtggagcaggaaaggcaaaggggacctgatggagtgtctctcctgccagggctccctccttccggctgccacccgatcccagcttgccctgcatcctggtgggtccaggcactggcattgcccccttccggggattctggcaggagcggctgcatgacattgagagcaaaggtgaggctggggactaaaggactgcctgaagggagtcacacaatctagggacagaggggtggggctggaaggcaggaaataggaaagagagggcaggaaacaaagtccacaaagctgaaaagacgctcatgagaccaaggggagggcaggtaccaaaggcaagggctgggccctgagcttctggcttcctggtgcctggtacatagtaggtgttgactggattgaggacaaaggaaaatagaattttcaaagggattagggctaagactcaaagaagaactgcccaaggtggattcttgactgtgccagagctgaccgaggtctgtccaagacctaaggatgctacaaggtgttcatattgagcatggggtgcccagggtggtctgtcaatcaaaagaagagggctgtgactgggaggagagttataagtatgggagaatatgaagtgggagcggggaaggggactgcgatgtcacacaatgcaaagggcatggaattctgagtccgaagccgcgcattctagcgcagctccaccaggggccaccacctcacccgcgcttcccttccctctgtaaatcagggctgtgcagggtctctgtgaaagcattctacactctcttagagatgaaacagccaaagtaatggtggtttcagcccaaaacgctgggctgccaggctgggcgacggtggcctgtggggaggccccactagcactgtgccccggagaagagccttcccaagcgcggggttgcttgcagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaaggtgtgagaccctgagggcgcaatggtaacacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggtgcggaggggcgggccgggcctgagcgtgcggggttcctgctaaggtctccgagtcgggttctgatccactgtgctcttttccgacaggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcccgaccaggatcagccccgctcctcccctcttgaggtggtgccttctcacatctgtccagaggctgcaaggattcagcattattcctccaggaaggagcaaaacgcctcttttccctctctaggcctgttgcctcgggcctgggtccgccttaatctggaaggcccctcccagcagcggtaccccagggcctactgccacccgcttcctgtttcttagtcgaatgttagattcctcttgcctctctcaggagtatcttacctgtaaagtctaatctctaaatcaagtatttattattgaagatttaccataagggactgtgccagatgttaggagaactactaaagtgcctaccccagctca

SEQ ID NO: 369580 - DNA, 1917 bp, Homo sapiens
agttgttttttgttttttgttttttttttaatttttttttgagatgggaagaacttgggtcctccttgctccacccaccctgcatggtgagaatggtggagcaggaaaggcaaaggggacctgatggagtgtctctcctgccagggctccctccttccggctgccacccgatcccagcttgccctgcatgacattgagagcaaaggtgaggctggggactaaaggactgcctgaagggagtcacacaatctagggacagaggggtggggctggaaggcaggaaataggaaagagagggcaggaaacaaagtccacaaagctgaaaagacgctcatgagaccaaggggagggcaggtaccaaaggcaagggctgggccctgagcttctggcttcctggtgcctggtacatagtaggtgttgactggattgaggacaaaggaaaatagaattttcaaagggattagggctaagactcaaagaagaactgcccaaggtggattcttgactgtgccagagctgaccgaggtctgtccaagacctaaggatgctacaaggtgttcatattgagcatggggtgcccagggtggtctgtcaatcaaaagaagagggctgtgactgggaggagagttataagtatgggagaatatgaagtgggagcggggaaggggactgcgatgtcacacaatgcaaagggcatggaattctgagtccgaagccgcgcattctagcgcagctccaccaggggccaccacctcacccgcgcttcccttccctctgtaaatcagggctgtgcagggtctctgtgaaagcattctacactctcttagagatgaaacagccaaagtaatggtggtttcagcccaaaacgctgggctgccaggctgggcgacggtggcctgtggggaggccccactagcactgtgccccggagaagagccttcccaagcgcggggttgcttgcagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaaggtgtgagaccctgagggcgcaatggtaacacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcccgaccaggatcagccccgctcctcccctcttgaggtggtgccttctcacatctgtccagaggctgcaaggattcagcattattcctccaggaaggagcaaaacgcctcttttccctctctaggcctgttgcctcgggcctgggtccgccttaatctggaaggcccctcccagcagcggtaccccagggcctactgccacccgcttcctgtttcttagtcgaatgttagattcctcttgcctctctcaggagtatcttacctgtaaagtctaatctctaaatcaagtatttattattgaagatttaccataagggactgtgccagatgttaggagaactactaaagtgcctaccccagctca

SEQ ID NO: 369581 - DNA, 1803 bp, Homo sapiens
agttgttttttgttttttgttttttttttaatttttttttgagatgggaagaacttgggtcctccttgctccacccaccctgcatggtgagaatggtggagcaggaaaggcaaaggggacctgatggagtgtctctcctgccagggctccctccttccggctgccacccgatcccagcttgccctgcatcctggtgggtccaggcactggcattgcccccttccggggattctggcaggagcggcaaaggcaagggctgggccctgagcttctggcttcctggtgcctggtacatagtaggtgttgactggattgaggacaaaggaaaatagaattttcaaagggattagggctaagactcaaagaagaactgcccaaggtggattcttgactgtgccagagctgaccgaggtctgtccaagacctaaggatgctacaaggtgttcatattgagcatggggtgcccagggtggtctgtcaatcaaaagaagagggctgtgactgggaggagagttataagtatgggagaatatgaagtgggagcggggaaggggactgcgatgtcacacaatgcaaagggcatggaattctgagtccgaagccgcgcattctagcgcagctccaccaggggccaccacctcacccgcgcttcccttccctctgtaaatcagggctgtgcagggtctctgtgaaagcattctacactctcttagagatgaaacagccaaagtaatggtggtttcagcccaaaacgctgggctgccaggctgggcgacggtggcctgtggggaggccccactagcactgtgccccggagaagagccttcccaagcgcggggttgcttgcagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaaggtgtgagaccctgagggcgcaatggtaacacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcccgaccaggatcagccccgctcctcccctcttgaggtggtgccttctcacatctgtccagaggctgcaaggattcagcattattcctccaggaaggagcaaaacgcctcttttccctctctaggcctgttgcctcgggcctgggtccgccttaatctggaaggcccctcccagcagcggtaccccagggcctactgccacccgcttcctgtttcttagtcgaatgttagattcctcttgcctctctcaggagtatcttacctgtaaagtctaatctctaaatcaagtatttattattgaagatttaccataagggactgtgccagatgttaggagaactactaaagtgcctaccccagctca

SEQ ID NO: 369582 - DNA, 1196 bp, Homo sapiens
agttgttttttgttttttgttttttttttaatttttttttgagatgggaagaacttgggtcctccttgctccacccaccctgcatggtgagaatggtggagcaggaaaggcaaaggggacctgatggagtgtctctcctgccagggctccctccttccggctgccacccgatcccagcttgccctgcatcctggtgggtccaggcactggcattgcccccttccggggattctggcaggagcggctgcatgacattgagagcaaaggtgaggctggggactaaaggactgcctgaagggagtcacacaatctagggacagaggggtggggctggaaggcaggaaataggaaagagagggcaggaaacaaagtccacaaagctgaaaagacgctcatgagaccaaggggagggcaggtaccaaaggcaagggctgggccctgagcttctggcttcctggtgcctggtacatagtaggtgttgactggattgaggacaaaggaaaatagaattttcaaagggattagggctaagactcaaagaagaactgcccaaggtggattcttgactgtgccagagctgaccgaggtctgtccaagacctaaggatgctacaaggtgttcatattgagcatggggtgcccagggtggtctgtcaatcaaaagaagagggctgtgactgggaggagagttataagtatgggagaatatgaagtgggagcggggaaggggactgcgatgtcacacaatgcaaagggcatggaattctgagtccgaagccgcgcattctagcgcagctccaccaggggccaccacctcacccgcgcttcccttccctctgtaaatcagggctgtgcagggtctctgtgaaagcattctacactctcttagagatgaaacagccaaagtaatggtggttggcaggaaacaaagtccacaaagctgaaaagacgctcatgagaccaaggggagggcaggtaccaaaggcaagggctgggccctgagcttctggcttcctggtgcctggtacatagtaggtgttgactggattgaggacaaaggaaaatagaattttcaaagggattagggctaagactcaaagaagaactgcccaaggtggattcttgactgtgccagagctgaccgaggtctgtccaagacctaaggatgctacaaggtgttcatattgagcatggggt

SEQ ID NO: 369583 - DNA, 3255 bp, Homo sapiens
  misc_feature (4)..(6): n is a, c, g, or t
  misc_feature (18)..(19): n is a, c, g, or t
  misc_feature (22)..(23): n is a, c, g, or t
  misc_feature (31)..(31): n is a, c, g, or t
gaannnccactctgctgnngcnncagcaganggacgcacagtaacatgggcaacttgaagagcgtggcccaggagcctgggccaccctgcggcctggggctggggctgggccttgggctgtgcggcaagcagggcccagccaccccggcccctgagcccagccgggccccagcatccctactcccaccagcgccagaacacagccccccgagctccccgctaacccagcccccagaggggcccaagttccctcgtgtgaagaactgggaggtggggagcatcacctatgacaccctcagcgcccaggcgcagcaggatgggccctgcaccccaagacgctgcctgggctccctggtatttccacggaaactacagggccggccctcccccggccccccggcccctgagcagctgctgagtcaggcccgggacttcatcaaccagtactacagctccattaagaggagcggctcccaggcccacgaacagcggcttcaagaggtggaagccgaggtggcagccacaggcacctaccagcttagggagagcgagctggtgttcggggctaagcaggcctggcgcaacgctccccgctgcgtgggccggatccagtgggggaagctgcaggtgttcgatgcccgggactgcaggtctgcacaggaaatgttcacctacatctgcaaccacatcaagtatgccaccaaccggggcaaccttcgctcggccatcacagtgttcccgcagcgctgccctggccgaggagacttccgaatctggaacagccagctggtgcgctacgcgggctaccggcagcaggacggctctgtgcggggggacccagccaacgtggagatcaccgagctctgcattcagcacggctggaccccaggaaacggtcgcttcgacgtgctgcccctgctgctgcaggccccagatgagcccccagaactcttccttctgccccccgagctggtccttgaggtgcccctggagcaccccacgctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggatgtggctgtctgcatggacctggatacccggaccacctcgtccctgtggaaagacaaggcagcagtggaaatcaacgtggccgtgctgcacagttaccagctagccaaagtcaccatcgtggaccaccacgccgccacggcctctttcatgaagcacctggagaatgagcagaaggccagggggggctgccctgcagactgggcctggatcgtgccccccatctcgggcagcctcactcctgttttccatcaggagatggtcaactatttcctgtccccggccttccgctaccagccagacccctggaaggggagtgccgccaagggcaccggcatcaccaggaagaagacctttaaagaagtggccaacgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtcctgtgtatggatgagtatgacgtggtgtccctcgaacacgagacgctggtgctggtggtaaccagcacatttgggaatggggatcccccggagaatggagagagctttgcagctgccctgatggagatgtccggcccctacaacagctcccctcggccggaacagcacaagagttataagatccgcttcaacagcatctcctgctcagacccactggtgtcctcttggcggcggaagaggaaggagtccagtaacacagacagtgcaggggccctgggcaccctcaggttctgtgtgttcgggctcggctcccgggcatacccccacttctgcgcctttgctcgtgccgtggacacacggctggaggaactgggcggggagcggctgctgcagctgggccagggcgacgagctgtgcggccaggaggaggccttccgaggctgggcccaggctgccttccaggccgcctgtgagaccttctgtgtgggagaggatgccaaggccgccgcccgagacatcttcagccccaaacggagctggaagcgccagaggtaccggctgagcgcccaggccgagggcctgcagttgctgccaggtctgatccacgtgcacaggcggaagatgttccaggctacaatccgctcagtggaaaacctgcaaagcagcaagtccacgagggccaccatcctggtgcgcctggacaccggaggccaggaggggctgcagtaccagccgggggaccacataggtgtctgcccgcccaaccggcccggccttgtggaggcgctgctgagccgcgtggaggacccgccggcgcccactgagcccgtggcagtagagcagctggagaagggcagccctggtggccctccccccggctgggtgcgggacccccggctgcccccgtgcacgctgcgccaggctctcaccttcttcctggacatcacctccccacccagccctcagctcttgcggctgctcagcaccttggcagaagagcccagggaacagcaggagctggaggccctcagccaggatccccgacgctacgaggagtggaagtggttccgctgccccacgctgctggaggtgctggagcagttcccgtcggtggcgctgcctgccccactgctcctcacccagctgcctctgctccagccccggtactactcagtcagctcggcacccagcacccacccaggagagatccacctcactgtagctgtgctggcatacaggactcaggatgggctgggccccctgcactatggagtctgctccacgtggctaagccagctcaagcccggagaccctgtgccctgcttcatccggggggctccctccttccgccatttcacttctaacttcctgtgtctaacatgattctagctctggactttctccttcgtgtgatccagccaagacctggcgggcttggctcttccttcccagaagagccagtgaccacccaggctagaggtcctttgccctagcagctatgccacgccgcatctcaccgctggccatagttgaactcccgctgtgagcgtcgcaagaaga

SEQ ID NO: 369584 - DNA, 2076 bp, Homo sapiens
  misc_feature (4)..(6): n is a, c, g, or t
  misc_feature (18)..(19): n is a, c, g, or t
  misc_feature (22)..(23): n is a, c, g, or t
  misc_feature (31)..(31): n is a, c, g, or t
gaannnccactctgctgnngcnncagcaganggacgcacagtaacatgggcaacttgaagagcgtggcccaggagcctgggccaccctgcggcctggggctggggctgggccttgggctgtgcggcaagcagggcccagccaccccggcccctgagcccagccgggccccagcatccctactcccaccagcgccagaacacagccccccgagctccccgctaacccagcccccagaggggcccaagttccctcgtgtgaagaactgggaggtggggagcatcacctatgacaccctcagcgcccaggcgcagcaggatgggccctgcaccccaagacgctgcctgggctccctggtatttccacggaaactacagggccggccctcccccggccccccggcccctgagcagctgctgagtcaggcccgggacttcatcaaccagtactacagctccattaagaggagcggctcccaggcccacgaacagcggcttcaagaggtggaagccgaggtggcagccacaggcacctaccagcttagggagagcgagctggtgttcggggctaagcaggcctggcgcaacgctccccgctgcgtgggccggatccagtgggggaagctgcaggtgttcgatgcccgggactgcaggtctgcacaggaaatgttcacctacatctgcaaccacatcaagtatgccaccaaccggggcaaccttcgctcggccatcacagtgttcccgcagcgctgccctggccgaggagacttccgaatctggaacagccagctggtgcgctacgcgggctaccggcagcaggacggctctgtgcggggggacccagccaacgtggagatcaccgagctctgcattcagcacggctggaccccaggaaacggtcgcttcgacgtgctgcccctgctgctgcaggccccagatgagcccccagaactcttccttctgccccccgagctggtccttgaggtgcccctggagcaccccacgctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggatgtggctgtctgcatggacctggatacccggaccacctcgtccctgtggaaagacaaggcagcagtggaaatcaacgtggccgtgctgcacagttaccagctagccaaagtcaccatcgtggaccaccacgccgccacggcctctttcatgaagcacctggagaatgagcagaaggccagggggggctgccctgcagactgggcctggatcgtgccccccatctcgggcagcctcactcctgttttccatcaggagatggtcaactatttcctgtccccggccttccgctaccagccagacccctggaaggggagtgccgccaagggcaccggcatcaccaggaagaagacctttaaagaagtggccaacgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtcctgtgtatggatgagtatgacgtggtgtccctcgaacacgagacgctggtgctggtggtaaccagcacatttgggaatggggatcccccggagaatggagagtctgtctccctgccagaagtgtctgtcaccacagaatagtttcgcctgctctagaacggcacctagatggaagcacgcagtgttgcggcgtctcctgctgaggctgtttttgaggcgcactcgtgttgctgcgtgactcagtatttcactcattctgctgctgagtgccgttcattgtgtgaatatccccagtttgtttacccattctcttgttggtgacacttgggctgtttccaggtcggggctattatgaataaacctgttatgaacattcttgta

SEQ ID NO: 369585 - DNA, 516 bp, Homo sapiens
agccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcccgaccaggatcagccccgctcctcccctcttgaggtggtgccttctcacatctgtccagaggctgcaaggattcagcattattcctccaggaaggagcaaaacgcctcttttccctctctaggcctgttgcctcgggcctgggtccgccttaatctggaaggcccctcccagcagcggtaccccagggcctactgccacccgcttcctgtttcttagtcgaatgttagattcctcttgcctctctcaggagtatcttacctgtaaagtctaatctctaaatcaagtatttattattgaagatttaccataagggactgtgccagatgttaggagaactactaaagtgcctacccca

SEQ ID NO: 369586 - DNA, 231 bp, Homo sapiens
ggggtgtttggccgagtcctcaccgccttctcccgggaacctgacaaccccaaggtgtgagaccctgagggcgcaatggtaacctgaagatagggagagaggggaggactcgcgctctccagcggggcacaccaaccacggccctcccgtggcctcccacgaccactcagccacccctgcacactctggcccacccttgtgccccggcccctctaggcccgcctcctcccg

SEQ ID NO: 369587 - DNA, 131 bp, Homo sapiens
tccaacccactgcatcctgccccgccaggatccccgacgctacgaggagtggaagtggttccgctgccccacgctgctggaggtgctggagcagttcccgtcggtggcgctgcctgccccactgctcctca

SEQ ID NO: 369588 - DNA, 246 bp, Homo sapiens
cctaacccggctggttctctgaggcccccacaccccgggactaaagcactctggggccaggccctgctccctagctcaggctgcctcatttgcccctccccgcccccaggtctgatccacgtgcacaggcggaagatgttccaggctacaatccgctcagtggaaaacctgcaaagcagcaagtccacgtgaggacgacggctttaccgcccccccacccctgtcctgaacaccctgaccctggac

SEQ ID NO: 369589 - DNA, 4470 bp, Homo sapiens
  misc_feature (4)..(6): n is a, c, g, or t
  misc_feature (18)..(19): n is a, c, g, or t
  misc_feature (22)..(23): n is a, c, g, or t
  misc_feature (31)..(31): n is a, c, g, or t
gaannnccactctgctgnngcnncagcaganggacgcacagtaacatgggcaacttgaagagcgtggcccaggagcctgggccaccctgcggcctggggctggggctgggccttgggctgtgcggcaagcagggcccagccaccccggcccctgagcccagccgggccccagcatccctactcccaccagcgccagaacacagccccccgagctccccgctaacccagcccccagaggggcccaagttccctcgtgtgaagaactgggaggtggggagcatcacctatgacaccctcagcgcccaggcgcagcaggatgggccctgcaccccaagacgctgcctgggctccctggtatttccacggaaactacagggccggccctcccccggccccccggcccctgagcagctgctgagtcaggcccgggacttcatcaaccagtactacagctccattaagaggagcggctcccaggcccacgaacagcggcttcaagaggtggaagccgaggtggcagccacaggcacctaccagcttagggagagcgagctggtgttcggggctaagcaggcctggcgcaacgctccccgctgcgtgggccggatccagtgggggaagctgcaggtgttcgatgcccgggactgcaggtctgcacaggaaatgttcacctacatctgcaaccacatcaagtatgccaccaaccggggcaaccttcgctcggccatcacagtgttcccgcagcgctgccctggccgaggagacttccgaatctggaacagccagctggtgcgctacgcgggctaccggcagcaggacggctctgtgcggggggacccagccaacgtggagatcaccgagctctgcattcagcacggctggaccccaggaaacggtcgcttcgacgtgctgcccctgctgctgcaggccccagatgagcccccagaactcttccttctgccccccgagctggtccttgaggtgcccctggagcaccccacgctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggatgtggctgtctgcatggacctggatacccggaccacctcgtccctgtggaaagacaaggcagcagtggaaatcaacgtggccgtgctgcacagttaccagctagccaaagtcaccatcgtggaccaccacgccgccacggcctctttcatgaagcacctggagaatgagcagaaggccagggggggctgccctgcagactgggcctggatcgtgccccccatctcgggcagcctcactcctgttttccatcaggagatggtcaactatttcctgtccccggccttccgctaccagccagacccctggaaggggagtgccgccaagggcaccggcatcaccaggaagaagacctttaaagaagtggccaacgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtcctgtgtatggatgagtatgacgtggtgtccctcgaacacgagacgctggtgctggtggtaaccagcacatttgggaatggggatcccccggagaatggagagagctttgcagctgccctgatggagatgtccggcccctacaacagctcccctcggccggaacagcacaagagttataagatccgcttcaacagcatctcctgctcagacccactggtgtcctcttggcggcggaagaggaaggagtccagtaacacagacagtgcaggggccctgggcaccctcaggttctgtgtgttcgggctcggctcccgggcatacccccacttctgcgcctttgctcgtgccgtggacacacggctggaggaactgggcggggagcggctgctgcagctgggccagggcgacgagctgtgcggccaggaggaggccttccgaggctgggcccaggctgccttccaggccgcctgtgagaccttctgtgtgggagaggatgccaaggccgccgcccgagacatcttcagccccaaacggagctggaagcgccagaggtaccggctgagcgcccaggccgagggcctgcagttgctgccaggtctgatccacgtgcacaggcggaagatgttccaggctacaatccgctcagtggaaaacctgcaaagcagcaagtccacgagggccaccatcctggtgcgcctggacaccggaggccaggaggggctgcagtaccagccgggggaccacataggtgtctgcccgcccaaccggcccggccttgtggaggcgctgctgagccgcgtggaggacccgccggcgcccactgagcccgtggcagtagagcagctggagaagggcagccctggtggccctccccccggctgggtgcgggacccccggctgcccccgtgcacgctgcgccaggctctcaccttcttcctggacatcacctccccacccagccctcagctcttgcggctgctcagcaccttggcagaagagcccagggaacagcaggagctggaggccctcagccaggatccccgacgctacgaggagtggaagtggttccgctgccccacgctgctggaggtgctggagcagttcccgtcggtggcgctgcctgccccactgctcctcacccagctgcctctgctccagccccggtactactcagtcagctcggcacccagcacccacccaggagagatccacctcactgtagctgtgctggcatacaggactcaggatgggctgggccccctgcactatggagtctgctccacgtggctaagccagctcaagcccggagaccctgtgccctgcttcatccggggggctccctccttccggctgccacccgatcccagcttgccctgcatcctggtgggtccaggcactggcattgcccccttccggggattctggcaggagcggctgcatgacattgagagcaaagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaagacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcccgaccaggatcagccccgctcctcccctcttgaggtggtgccttctcacatctgtccagaggctgcaaggattcagcattattcctccaggaaggagcaaaacgcctcttttccctctctaggcctgttgcctcgggcctgggtccgccttaatctggaaggcccctcccagcagcggtaccccagggcctactgccacccgcttcctgtttcttagtcgaatgttagattcctcttgcctctctcaggagtatcttacctgtaaagtctaatctctaaatcaagtatttattattgaagatttaccataagggactgtgccagatgttaggagaactactaaagtgcctaccccagctcatgtggattacagtttttttttttttggtttttttttttttgaaacggagtctccctctgccgcccgggctggagtgcagtggcgtgatctcagctcactgcaacctccaccccacaagttcaagtgattctcctgcctcagcctcccaagtagttgggattacaggtgcctgccaccgcgcccggctaggttttgtatttttagtaaagacggggtttcaccatcttggccaggctggtcttgaactcctgacctcgtgatccaaccgcctcagcctcccaaagtgctgggattacaggtgtgagctactgcacccggcgtggattacaattataaaatgacaagatttctgttttaacctgtgcagttgtgggtatgtggtggggaaaggggt

SEQ ID NO: 369590 - DNA, 1920 bp, Homo sapiens
agttgttttttgttttttgttttttttttaatttttttttgagatgggaagaacttgggtcctccttgctccacccaccctgcatggtgagaatggtggagcaggaaaggcaaaggggacctgatggagtgtctctcctgccagggctccctccttccggctgccacccgatcccagcttgccctgcatcctggtgggtccaggcactggcattgcccccttccggggattctggcaggagcggctgcatgacattgagagcaaaggtggggctggaaggcaggaaataggaaagagagggcaggaaacaaagtccacaaagctgaaaagacgctcatgagaccaaggggagggcaggtaccaaaggcaagggctgggccctgagcttctggcttcctggtgcctggtacatagtaggtgttgactggattgaggacaaaggaaaatagaattttcaaagggattagggctaagactcaaagaagaactgcccaaggtggattcttgactgtgccagagctgaccgaggtctgtccaagacctaaggatgctacaaggtgttcatattgagcatggggtgcccagggtggtctgtcaatcaaaagaagagggctgtgactgggaggagagttataagtatgggagaatatgaagtgggagcggggaaggggactgcgatgtcacacaatgcaaagggcatggaattctgagtccgaagccgcgcattctagcgcagctccaccaggggccaccacctcacccgcgcttcccttccctctgtaaatcagggctgtgcagggtctctgtgaaagcattctacactctcttagagatgaaacagccaaagtaatggtggtttcagcccaaaacgctgggctgccaggctgggcgacggtggcctgtggggaggccccactagcactgtgccccggagaagagccttcccaagcgcggggttgcttgcagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaaggtgtgagaccctgagggcgcaatggtaacacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcccgaccaggatcagccccgctcctcccctcttgaggtggtgccttctcacatctgtccagaggctgcaaggattcagcattattcctccaggaaggagcaaaacgcctcttttccctctctaggcctgttgcctcgggcctgggtccgccttaatctggaaggcccctcccagcagcggtaccccagggcctactgccacccgcttcctgtttcttagtcgaatgttagattcctcttgcctctctcaggagtatcttacctgtaaagtctaatctctaaatcaagtatttattattgaagatttaccataagggactgtgccagatgttaggagaactactaaagtgcctaccccagctca

SEQ ID NO: 369591 - DNA, 1932 bp, Homo sapiens
  misc_feature (4)..(6): n is a, c, g, or t
  misc_feature (18)..(19): n is a, c, g, or t
  misc_feature (22)..(23): n is a, c, g, or t
  misc_feature (31)..(31): n is a, c, g, or t
gaannnccactctgctgnngcnncagcaganggacgcacagtaacatgggcaacttgaagagcgtggcccaggagcctgggccaccctgcggcctggggctggggctgggccttgggctgtgcggcaagcagggcccagccaccccggcccctgagcccagccgggccccagcatccctactcccaccagcgccagaacacagccccccgagctccccgctaacccagcccccagaggggcccaagttccctcgtgtgaagaactgggaggtggggagcatcacctatgacaccctcagcgcccaggcgcagcaggatgggccctgcaccccaagacgctgcctgggctccctggtatttccacggaaactacagggccggccctcccccggccccccggcccctgagcagctgctgagtcaggcccgggacttcatcaaccagtactacagctccattaagaggagcggctcccaggcccacgaacagcggcttcaagaggtggaagccgaggtggcagccacaggcacctaccagcttagggagagcgagctggtgttcggggctaagcaggcctggcgcaacgctccccgctgcgtgggccggatccagtgggggaagctgcaggtgttcgatgcccgggactgcaggtctgcacaggaaatgttcacctacatctgcaaccacatcaagtatgccaccaaccggggcaaccttcgctcggccatcacagtgttcccgcagcgctgccctggccgaggagacttccgaatctggaacagccagctggtgcgctacgcgggctaccggcagcaggacggctctgtgcggggggacccagccaacgtggagatcaccgagctctgcattcagcacggctggaccccaggaaacggtcgcttcgacgtgctgcccctgctgctgcaggccccagatgagcccccagaactcttccttctgccccccgagctggtccttgaggtgcccctggagcaccccacgctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggatgtggctgtctgcatggacctggatacccggaccacctcgtccctgtggaaagacaaggcagcagtggaaatcaacgtggccgtgctgcacagttaccagctagccaaagtcaccatcgtggaccaccacgccgccacggcctctttcatgaagcacctggagaatgagcagaaggccagggggggctgccctgcagactgggcctggatcgtgccccccatctcgggcagcctcactcctgttttccatcaggagatggtcaactatttcctgtccccggccttccgctaccagccagacccctggaaggggagtgccgccaagggcaccggcatcaccaggaagaagacctttaaagaagtggccaacgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtcctgtgtatggatgagtatgacgtggtgtccctcgaacacgagacgctggtgctggtggtaaccagcacatttgggaatggggatcccccggagaatggagagaacctatttacgttgcccaggctggccttgaactcctagcctcaagagatcctcctgccgcaggctcctttttcaaaagaagaaattgagcgctgtttagatgccaacatagattaaataacttcactttttaaa

SEQ ID NO: 369592 - DNA, 420 bp, Homo sapiens
gcatttggggaaatgggttaagctattgtgaaatttcttcaagggattaagctaggatatcatttcagttacttgtagaattacttttttcataccagttatgaaatgctgcaagataatgttgaaggatatcgtcgagaaataacatcacttcatgagagaaatcagaaactcactgccacaactcaaaagcaagaacagattatcaatacgatgactcaagatttgagaggagcaaatgagaagctagctgtcgcagaagtaagagcagaaaatttgaagaaggaaaaggaaatgcttaaattgtctgaagttcgtctttctcagcaaagagagtctttgttagctgaacaaagggggcaaaacttactgctaactaatctgcaaacaattcaggtaaccaaataaaaagcctatgta

SEQ ID NO: 369593 - DNA, 7976 bp, Homo sapiens
gcgcaagaggatcagggatagcctctgagctcgggttcccagggttcgtagcttccaacggctgcgcgcgcacttcggtcgcgggcggtgaggtgctgttgctgaaacgctgccgctgagggtggactcgatttcccagggtcccgccgcgggagtctccggcgggcgggcgcgcgcgagccaccgagcgaggtgatagaggcggcggcccaggcgtctgggtcctgctggtcttcgcctttcttctccgcttctaccccgtcggccgctgccactggggtccctggccccaccgacatggcggcggtgttgcagcaagtcctggagcgcacggagctgaacaagctgcccaagtctgtccagaacaaacttgaaaagttccttgctgatcagcaatccgagatcgatggcctgaaggggcggcatgagaaatttaaggtggagagcgaacaacagtattttgaaatagaaaagaggttgtcccacagtcaggagagacttgtgaatgaaacccgagagtgtcaaagcttgcggcttgagctagagaaactcaacaatcaactgaaggcactaactgagaaaaacaaagaacttgaaattgctcaggatcgcaatattgccattcagagccaatttacaagaacaaaggaagaattagaagctgagaaaagagacttaattagaaccaatgagagactatctcaagaacttgaatacttaacagaggatgttaaacgtctgaatgaaaaacttaaagaaagcaatacaacaaagggtgaacttcagttaaaattggatgaacttcaagcttctgatgtttctgttaagtatcgagaaaaacgcttggagcaagaaaaggaattgctacatagtcagaatacatggctgaatacagagttgaaaaccaaaactgatgaacttctggctcttggaagagaaaaagggaatgagattctagagcttaaatgtaatcttgaaaataaaaaagaagaggtttctagactggaagaacaaatgaatggcttaaaaacatcaaatgaacatcttcaaaagcatgtggaggatctgttgaccaaattaaaagaggccaaggaacaacaggccagtatggaagagaaattccacaatgaattaaatgcccacataaaactttctaatttgtacaagagtgccgctgatgactcagaagcaaagagcaatgaactaacccgggcagtagaggaactacacaaacttttgaaagaagctggtgaagccaacaaagcaatacaagatcatcttctagaggtggagcaatccaaagatcaaatggaaaaagaaatgcttgagaaaatagggagattggagaaggaattagagaatgcaaatgaccttctttctgccacaaaacgtaaaggagccatattgtctgaagaagagcttgccgccatgtctcctactgcagcagctgtagctaagatagtgaaacctgggatgaaactaactgagctctataatgcttatgtggaaactcaggatcagttgcttttggagaaactagagaacaaaagaattaataagtacctagatgaaatagtgaaagaagtggaagccaaagcaccaattttgaaacgccagcgtgaggaatatgaacgtgcacagaaagctgtagcaagtttatctgttaagcttgaacaagctatgaaggagattcagcgattgcaggaggacactgataaagccaacaagcaatcatctgtacttgagagagataatcgaagaatggaaatacaagtaaaagatctttcacaacagattagagtgcttttgatggaacttgaagaagcaaggggtaaccacgtaattcgtgatgaggaagtaagctctgctgatataagtagttcatctgaggtaatatcacagcatctagtatcttacagaaatattgaagagcttcaacaacaaaatcaacgtctcttagtggcccttagagagcttggggaaaccagagaaagagaagaacaagaaacaacttcatccaaaatcactgagcttcagctcaaacttgagagtgcccttactgaactagaacaactccgcaaatcacgacagcatcaaatgcagcttgttgattccatagttcgtcagcgtgatatgtaccgtattttattgtcacaaacaacaggagttgccattccattacatgcttcaagcttagatgatgtttctcttgcatcaactccaaaacgtccaagtacatcacagactgtttccactcctgctccagtacctgttattgaatcaacagaggctatagaggctaaggctgcccttaaacagttgcaggaaatttttgagaactacaaaaaagaaaaagcagaaaatgaaaaaatacaaaatgagcagcttgagaaacttcaagaacaagttacagatttgcgatcacaaaataccaaaatttctacccagctagattttgcttctaaacgttatgaaatgctgcaagataatgttgaaggatatcgtcgagaaataacatcacttcatgagagaaatcagaaactcactgccacaactcaaaagcaagaacagattatcaatacgatgactcaagatttgagaggagcaaatgagaagctagctgtcgcagaagtaagagcagaaaatttgaagaaggaaaaggaaatgcttaaattgtctgaagttcgtctttctcagcaaagagagtctttgttagctgaacaaagggggcaaaacttactgctaactaatctgcaaacaattcagggaatactggagcgatctgaaacagaaaccaaacaaaggcttagtagccagatagaaaaactggaacatgagatctctcatctaaagaagaagttggaaaatgaggtggaacaaaggcatacacttactagaaatctagatgttcaacttttagatacaaagagacaactggatacagagacaaatcttcatcttaacacaaaagaactattaaaaaatgctcaaaaagaaattgccacattgaaacagcacctcagtaatatggaagtccaagttgcttctcagtcttcacagagaactggtaaaggtcagcctagcaacaaagaagatgtggatgatcttgtgagtcagctaagacagacagaagagcaggtgaatgacttaaaggagagactcaaaacaagtacgagcaatgtggaacaatatcaagcaatggttactagtttagaagaatccctgaacaaggaaaaacaggtgacagaagaagtgcgtaagaatattgaagttcgtttaaaagagtcagctgaatttcagacacagttggaaaagaagttgatggaagtagagaaggaaaaacaagaacttcaggatgataaaagaagagccatagagagcatggaacaacagttatctgaattgaagaaaacactttctagtgttcagaatgaagtacaagaagctcttcagagagcaagcacagctttaagtaatgagcagcaagccagacgtgactgtcaggaacaagctaaaatagctgtggaagctcagaataagtatgagagagaattgatgctgcatgctgctgatgttgaagctctacaagctgcgaaggagcaggtttcaaaaatggcatcagtccgtcagcatttggaagaaacaacacagaaagcagaatcacagttgttggagtgtaaagcatcttgggaggaaagagagagaatgttaaaggatgaagtttccaaatgtgtatgtcgctgtgaagatctggagaaacaaaacagattacttcatgatcagatcgaaaaattaagtgacaaggtcgttgcctctgtgaaggaaggtgtacaaggtccactgaatgtatctctcagtgaagaaggaaaatctcaagaacaaattttggaaattctcagatttatacgacgagaaaaagaaattgctgaaactaggtttgaggtggctcaggttgagagtctgcgttatcgacaaagggttgaacttttagaaagagagctgcaggaactgcaagatagtctaaatgctgaaagggagaaagtccaggtaactgcaaaaacaatggctcagcatgaagaactgatgaagaaaactgaaacaatgaatgtagttatggagaccaataaaatgctaagagaagagaaggagagactagaacaggatctacagcaaatgcaagcaaaggtgaggaaactggagttagatattttacccttacaagaagcaaatgctgagctgagtgagaaaagcggtatgttgcaggcagagaagaagctcttagaagaggatgtcaaacgttggaaagcacgtaaccagcatctagtaagtcaacagaaagatccagatacagaagaatatcggaagctcctttctgaaaaggaagttcatactaagcgtattcaacaattgacagaagaaattggtagacttaaagctgaaattgcaagatcaaatgcatctttgactaacaaccagaacttaattcagagtctgaaggaagatctaaataaagtaagaactgaaaaggaaaccatccagaaggacttagatgccaaaataattgatatccaagaaaaagtcaaaactattactcaagttaagaaaattggacgtaggtacaagactcaatatgaagaacttaaagcacaacaggataaggttatggagacatcggctcagtcctctggagaccatcaggagcagcatgtttcagtccaggaaatgcaggaactcaaagaaacgctcaaccaagctgaaacaaaatcaaaatcacttgaaagtcaagtagagaatctgcagaagacattatctgaaaaagagacagaagcaagaaatctccaggaacagactgtgcaacttcagtctgaactttcacgacttcgtcaggatcttcaagatagaaccacacaggaggagcagctccgacaacagataactgaaaaggaagaaaaaaccagaaaggctattgtagcagcaaagtcaaaaattgcacacttagctggtgtaaaagatcagctaactaaagaaaatgaggagcttaaacaaaggaatggagccttagatcagcagaaagatgaattggatgttcgcattactgcgctaaagtcccaatatgaaggtcgaattagtcgcttggaaagagaactcagggagcatcaagagagacaccttgagcagagagatgagcctcaagaaccttctaataaggtccctgaacagcagagacagatcacattgaaaacaactccagcttctggtgaaagaggaattgccagcacatcagacccaccaacagccaatatcaagccaactcctgttgtgtctactccaagtaaagtgacagctgcagctatggctggaaataagtcaacacccagggctagtatccgcccaatggttacacctgcaactgttacaaatcccactactaccccaacagctacagtgatgcccactacacaagtggaatcacaggaagctatgcagtcagaagggcctgtggaacatgttccagtttttggaagcacaagtggatccgttcgttctactagtcctaatgtccagccttctatctctcaacctattttaactgttcagcaacaaacacaggctacagcttttgtgcaacccactcaacagagtcatcctcagattgagcctgccaatcaagagttatcttcaaacatagtagaggttgttcagagttcaccagttgagcggccttctacttccacagcagtatttggcacagtttcggctacccccagttcttctttgccaaagcgtacacgtgaagaggaagaggatagcaccatagaagcatcagaccaagtctctgatgatacagtggaaatgcctcttccaaagaagttgaaaagtgtcacacctgtaggaactgaggaagaagttatggcagaagaaagtactgatggagaggtagagactcaggtatacaaccaggattctcaagattccattggagaaggagttacccagggagattatacacctatggaagacagtgaagaaacctctcagtctctacaaatagatcttgggccacttcaatcagatcagcagacgacaacttcatcccaggatggtcaaggcaaaggagatgatgtcattgtaattgacagtgatgatgattatgaagaggatgaggaagatgatgatgatgatgaagatgacacagggatgggagatgagggtgaagatagtaatgaaggaactggtagtgccgatggcaatgatggttatgaagctgatgatgctgagggtggtgatgggactgatccaggtacagaaacagaagaaagtatgggtggaggtgaaggtaatcacagagctgctgattctcaaaacagtggtgaaggaaatacaggtgctgcagaatcttctttttctcaggaggtttctagagaacaacagccatcatcagcatctgaaagacaggcccctcgagcacctcagtcaccgagacgcccaccacatccacttcccccaagactgaccattcatgccccacctcaggagttgggaccaccagttcagagaattcagatgacccgaaggcagtctgtaggacgtggccttcagttgactccaggaataggtggcatgcaacagcatttttttgatgatgaagacagaacagttccaagtactccaactcttgtggtgccacatcgtactgatggatttgctgaagcaattcattcgccgcaggttgctggtgtccctagattccggtttgggccacctgaagatatgccacaaacaagttctagtcactctgatcttggccagcttgcttctcaaggaggtttaggaatgtatgaaacacccctgttcctagctcatgaagaagagtcaggtggccgaagtgttcccactactccactacaagtagcagccccagtgactgtatttactgagagcaccacctctgatgcttcggaacatgcctctcaatctgttccaatggtgactacatccactggcactttatctacaacaaatgaaacagcaacaggtgatgatggagatgaagtatttgtggaggcagaatctgaaggtattagttcagaagcaggcctagaaattgatagccagcaggaagaagagccggttcaagcatctgatgagtcagatctcccctccaccagccaggatcctccttctagctcatctgtagatactagtagtagtcaaccaaagcctttcagacgagtaagacttcagacaacattgagacaaggtgtccgtggtcgtcagtttaacagacagagaggtgtgagccatgcaatgggagggagaggaggaataaacagaggaaatattaattaaatggtctgtaaacaataacaactgtgaataagattatcaaatctgttttagtgtaatgattgtcaagtttaaaaacatttttatatataaactggtatactcatgtcaatattctttattaataaaatgtttttcagtgtcaaaatttattattcatttcttcattagttgactcctcctttgctcatcagtctaaggacagttgtaccagactttggataaggtctgcccagaacgagtagtaattgctcttgctgttctactaggcacatcaatgttatagtattgatctaaatggaagagaaaacatttttttagttaaaaagaaaacaatgcccaaactaaaaaataacttatgttgactattatgctcaaagacaatgtttatcattttaatagagatgtttttactaattaatttgaactttataacaaaaagaaaaacaattgcctagacttttcagcttttttgatgtttcaaaagattgacatttcaccatctttttgtaaaatcaggttcagctctcctttatgaagtaaacattaaagagtaaccaagtttgaaaaataatttacttggggttattccttttaaaaaatacatgccaatgtcattcatattatga

SEQ ID NO: 369594 - DNA, 7530 bp, Homo sapiens
gcgcaagaggatcagggatagcctctgagctcgggttcccagggttcgtagcttccaacggctgcgcgcgcacttcggtcgcgggcggtgaggtgctgttgctgaaacgctgccgctgagggtggactcgatttcccagggtcccgccgcgggagtctccggcgggcgggcgcgcgcgagccaccgagcgaggtgatagaggcggcggcccaggcgtctgggtcctgctggtcttcgcctttcttctccgcttctaccccgtcggccgctgccactggggtccctggccccaccgacatggcggcggtgttgcagcaagtcctggagcgcacggagctgaacaagctgcccaagtctgtccagaacaaacttgaaaagttccttgctgatcagcaatccgagatcgatggcctgaaggggcggcatgagaaatttaaggtggagagcgaacaacagtattttgaaatagaaaagaggttgtcccacagtcaggagagacttgtgaatgaaacccgagagtgtcaaagcttgcggcttgagctagagaaactcaacaatcaactgaaggcactaactgagaaaaacaaagaacttgaaattgctcaggatcgcaatattgccattcagagccaatttacaagaacaaaggaagaattagaagctgagaaaagagacttaattagaaccaatgagagactatctcaagaacttgaatacttaacagaggatgttaaacgtctgaatgaaaaacttaaagaaagcaatacaacaaagggtgaacttcagttaaaattggatgaacttcaagcttctgatgtttctgttaagtatcgagaaaaacgcttggagcaagaaaaggaattgctacatagtcagaatacatggctgaatacagagttgaaaaccaaaactgatgaacttctggctcttggaagagaaaaagggaatgagattctagagcttaaatgtaatcttgaaaataaaaaagaagaggtttctagactggaagaacaaatgaatggcttaaaaacatcaaatgaacatcttcaaaagcatgtggaggatctgttgaccaaattaaaagaggccaaggaacaacaggccagtatggaagagaaattccacaatgaattaaatgcccacataaaactttctaatttgtacaagagtgccgctgatgactcagaagcaaagagcaatgaactaacccgggcagtagaggaactacacaaacttttgaaagaagctggtgaagccaacaaagcaatacaagatcatcttctagaggtggagcaatccaaagatcaaatggaaaaagaaatgcttgagaaaatagggagattggagaaggaattagagaatgcaaatgaccttctttctgccacaaaacgtaaaggagccatattgtctgaagaagagcttgccgccatgtctcctactgcagcagctgtagctaagatagtgaaacctgggatgaaactaactgagctctataatgcttatgtggaaactcaggatcagttgcttttggagaaactagagaacaaaagaattaataagtacctagatgaaatagtgaaagaagtggaagccaaagcaccaattttgaaacgccagcgtgaggaatatgaacgtgcacagaaagctgtagcaagtttatctgttaagcttgaacaagctatgaaggagattcagcgattgcaggaggacactgataaagccaacaagcaatcatctgtacttgagagagataatcgaagaatggaaatacaagtaaaagatctttcacaacagattagagtgcttttgatggaacttgaagaagcaaggggtaaccacgtaattcgtgatgaggaagtaagctctgctgatataagtagttcatctgaggtaatatcacagcatctagtatcttacagaaatattgaagagcttcaacaacaaaatcaacgtctcttagtggcccttagagagcttggggaaaccagagaaagagaagaacaagaaacaacttcatccaaaatcactgagcttcagctcaaacttgagagtgcccttactgaactagaacaactccgcaaatcacgacagcatcaaatgcagcttgttgattccatagttcgtcagcgtgatatgtaccgtattttattgtcacaaacaacaggagttgccattccattacatgcttcaagcttagatgatgtttctcttgcatcaactccaaaacgtccaagtacatcacagactgtttccactcctgctccagtacctgttattgaatcaacagaggctatagaggctaaggctgcccttaaacagttgcaggaaatttttgagaactacaaaaaagaaaaagcagaaaatgaaaaaatacaaaatgagcagcttgagaaacttcaagaacaagttacagatttgcgatcacaaaataccaaaatttctacccagctagattttgcttctaaacgttatgaaatgctgcaagataatgttgaaggatatcgtcgagaaataacatcacttcatgagagaaatcagaaactcactgccacaactcaaaagcaagaacagattatcaatacgatgactcaagatttgagaggagcaaatgagaagctagctgtcgcagaagtaagagcagaaaatttgaagaaggaaaaggaaatgcttaaattgtctgaagttcgtctttctcagcaaagagagtctttgttagctgaacaaagggggcaaaacttactgctaactaatctgcaaacaattcagggaatactggagcgatctgaaacagaaaccaaacaaaggcttagtagccagatagaaaaactggaacatgagatctctcatctaaagaagaagttggaaaatgaggtggaacaaaggcatacacttactagaaatctagatgttcaacttttagatacaaagagacaactggatacagagacaaatcttcatcttaacacaaaagaactattaaaaaatgctcaaaaagaaattgccacattgaaacagcacctcagtaatatggaagtccaagttgcttctcagtcttcacagagaactggtaaaggtcagcctagcaacaaagaagatgtggatgatcttgtgagtcagctaagacagacagaagagcaggtgaatgacttaaaggagagactcaaaacaagtacgagcaatgtggaacaatatcaagcaatggttactagtttagaagaatccctgaacaaggaaaaacaggtgacagaagaagtgcgtaagaatattgaagttcgtttaaaagagtcagctgaatttcagacacagttggaaaagaagttgatggaagtagagaaggaaaaacaagaacttcaggatgataaaagaagagccatagagagcatggaacaacagttatctgaattgaagaaaacactttctagtgttcagaatgaagtacaagaagctcttcagagagcaagcacagctttaagtaatgagcagcaagccagacgtgactgtcaggaacaagctaaaatagctgtggaagctcagaataagtatgagagagaattgatgctgcatgctgctgatgttgaagctctacaagctgcgaaggagcaggtttcaaaaatggcatcagtccgtcagcatttggaagaaacaacacagaaagcagaatcacagttgttggagtgtaaagcatcttgggaggaaagagagagaatgttaaaggatgaagtttccaaatgtgtatgtcgctgtgaagatctggagaaacaaaacagattacttcatgatcagatcgaaaaattaagtgacaaggtcgttgcctctgtgaaggaaggtgtacaaggtccactgaatgtatctctcagtgaagaaggaaaatctcaagaacaaattttggaaattctcagatttatacgacgagaaaaagaaattgctgaaactaggtttgaggtggctcaggttgagagtctgcgttatcgacaaagggttgaacttttagaaagagagctgcaggaactgcaagatagtctaaatgctgaaagggagaaagtccaggtaactgcaaaaacaatggctcagcatgaagaactgatgaagaaaactgaaacaatgaatgtagttatggagaccaataaaatgctaagagaagagaaggagagactagaacaggatctacagcaaatgcaagcaaaggtgaggaaactggagttagatattttacccttacaagaagcaaatgctgagctgagtgagaaaagcggtatgttgcaggcagagaagaagctcttagaagaggatgtcaaacgttggaaagcacgtaaccagcatctagtaagtcaacagaaagatccagatacagaagaatatcggaagctcctttctgaaaaggaagttcatactaagcgtattcaacaattgacagaagaaattggtagacttaaagctgaaattgcaagatcaaatgcatctttgactaacaaccagaacttaattcagagtctgaaggaagatctaaataaagtaagaactgaaaaggaaaccatccagaaggacttagatgccaaaataattgatatccaagaaaaagtcaaaactattactcaagttaagaaaattggacgtaggtacaagactcaatatgaagaacttaaagcacaacaggataaggttatggagacatcggctcagtcctctggagaccatcaggagcagcatgtttcagtccaggaaatgcaggaactcaaagaaacgctcaaccaagctgaaacaaaatcaaaatcacttgaaagtcaagtagagaatctgcagaagacattatctgaaaaagagacagaagcaagaaatctccaggaacagactgtgcaacttcagtctgaactttcacgacttcgtcaggatcttcaagatagaaccacacaggaggagcagctccgacaacagataactgaaaaggaagaaaaaaccagaaaggctattgtagcagcaaagtcaaaaattgcacacttagctggtgtaaaagatcagctaactaaagaaaatgaggagcttaaacaaaggaatggagccttagatcagcagaaagatgaattggatgttcgcattactgcgctaaagtcccaatatgaaggtcgaattagtcgcttggaaagagaactcagggagcatcaagagagacaccttgagcagagagatgagcctcaagaaccttctaataaggtccctgaacagcagagacagatcacattgaaaacaactccagcttctggtgaaagaggaattgccagcacatcagacccaccaacagccaatatcaagccaactcctgttgtgtctactccaagtaaagtgacagctgcagctatggctggaaataagtcaacacccagggctagtatccgcccaatggttacacctgcaactgttacaaatcccactactaccccaacagctacagtgatgcccactacacaagtggaatcacaggaagctatgcagtcagaagggcctgtggaacatgttccagtttttggaagcacaagtggatccgttcgttctactagtcctaatgtccagccttctatctctcaacctattttaactgttcagcaacaaacacaggctacagcttttgtgcaacccactcaacagagtcatcctcagattgagcctgccaatcaagagttatcttcaaacatagtagaggttgttcagagttcaccagttgagcggccttctacttccacagcagtatttggcacagtttcggctacccccagttcttctttgccaaagcgtacacgtgaagaggaagaggatagcaccatagaagcatcagaccaagtctctgatgatacagtggaaatgcctcttccaaagaagttgaaaagtgtcacacctgtaggaactgaggaagaagttatggcagaagaaagtactgatggagaggtagagactcaggtatacaaccaggattctcaagattccattggagaaggagttacccagggagattatacacctatggaagacagtgaagaaacctctcagtctctacaaatagatcttgggccacttcaatcagatcagcagacgacaacttcatcccaggatggtcaaggcaaaggagatgatgtcattgtaattgacagtgatgatgaagaagaggatgatgatgaaaatgatggagaacatgaggattatgaagaggatgaggaagatgatgatgatgatgaagatgacacagggatgggagatgagggtgaagatagtaatgaaggaactggtagtgccgatggcaatgatggttatgaagctgatgatgctgagggtggtgatgggactgatccaggtacagaaacagaagaaagtatgggtggaggtgaaggtaatcacagagctgctgattctcaaaacagtggtgaaggaaatacaggtgctgcagaatcttctttttctcaggaggtttctagagaacaacagccatcatcagcatctgaaagacaggcccctcgagcacctcagtcaccgagacgcccaccacatccacttcccccaagactgaccattcatgccccacctcaggagttgggaccaccagttcagagaattcagatgacccgaaggcagtctgtaggacgtggccttcagttgactccaggaataggtggcatgcaacagcatttttttgatgatgaagacagaacagttccaagtactccaactcttgtggtgccacatcgtactgatggatttgctgaagcaattcattcgccgcaggttgctggtgtccctagattccggtttgggccacctgaagatatgccacaaacaagttctagtcactctgatcttggccagcttgcttctcaaggaggtttaggaatgtatgaaacacccctgttcctagctcatgaagaagagtcaggtggccgaagtgttcccactactccactacaagtagcagccccagtgactgtatttactgagagcaccacctctgatgcttcggaacatgcctctcaatctgttccaatggtgactacatccactggcactttatctacaacaaatgaaacagcaacaggtgatgatggagatgaagtatttgtggaggcagaatctgaaggtattagttcagaagcaggcctagaaattgatagccagcaggaagaagagccggttcaagcatctgatgagtcagatctcccctccaccagccaggatcctccttctagctcatctgtagatactagtagtagtcaaccaaagcctttcagacgagtaagacttcagacaacattgagacaaggtgtccgtggtcgtcagtttaacagacagagaggtgtgagccatgcaatgggagggagaggaggaataaacagaggaaatattaattaaatggtctgtaaacaataacaactgtgaataagattatcaaatctgttttagtgtaatgattgtcaagtttaaaaacatttttatatataaactggtatactcatgtcaatattctttattaataaaatgtttttcagtgtc

SEQ ID NO: 369595 - DNA, 9982 bp, Homo sapiens
  misc_feature (5441)..(5441): n is a, c, g, or t
  misc_feature (5486)..(5486): n is a, c, g, or t
  misc_feature (5859)..(5859): n is a, c, g, or t
  misc_feature (5885)..(5885): n is a, c, g, or t
gcgcaagaggatcagggatagcctctgagctcgggttcccagggttcgtagcttccaacggctgcgcgcgcacttcggtcgcgggcggtgaggtgctgttgctgaaacgctgccgctgagggtggactcgatttcccagggtcccgccgcgggagtctccggcgggcgggcgcgcgcgagccaccgagcgaggtgatagaggcggcggcccaggcgtctgggtcctgctggtcttcgcctttcttctccgcttctaccccgtcggccgctgccactggggtccctggccccaccgacatggcggcggtgttgcagcaagtcctggagcgcacggagctgaacaagctgcccaagtctgtccagaacaaacttgaaaagttccttgctgatcagcaatccgagatcgatggcctgaaggggcggcatgagaaatttaaggtggagagcgaacaacagtattttgaaatagaaaagaggttgtcccacagtcaggagagacttgtgaatgaaacccgagagtgtcaaagcttgcggcttgagctagagaaactcaacaatcaactgaaggcactaactgagaaaaacaaagaacttgaaattgctcaggatcgcaatattgccattcagagccaatttacaagaacaaaggaagaattagaagctgagaaaagagacttaattagaaccaatgagagactatctcaagaacttgaatacttaacagaggatgttaaacgtctgaatgaaaaacttaaagaaagcaatacaacaaagggtgaacttcagttaaaattggatgaacttcaagcttctgatgtttctgttaagtatcgagaaaaacgcttggagcaagaaaaggaattgctacatagtcagaatacatggctgaatacagagttgaaaaccaaaactgatgaacttctggctcttggaagagaaaaagggaatgagattctagagcttaaatgtaatcttgaaaataaaaaagaagaggtttctagactggaagaacaaatgaatggcttaaaaacatcaaatgaacatcttcaaaagcatgtggaggatctgttgaccaaattaaaagaggccaaggaacaacaggccagtatggaagagaaattccacaatgaattaaatgcccacataaaactttctaatttgtacaagagtgccgctgatgactcagaagcaaagagcaatgaactaacccgggcagtagaggaactacacaaacttttgaaagaagctggtgaagccaacaaagcaatacaagatcatcttctagaggtggagcaatccaaagatcaaatggaaaaagaaatgcttgagaaaatagggagattggagaaggaattagagaatgcaaatgaccttctttctgccacaaaacgtaaaggagccatattgtctgaagaagagcttgccgccatgtctcctactgcagcagctgtagctaagatagtgaaacctgggatgaaactaactgagctctataatgcttatgtggaaactcaggatcagttgcttttggagaaactagagaacaaaagaattaataagtacctagatgaaatagtgaaagaagtggaagccaaagcaccaattttgaaacgccagcgtgaggaatatgaacgtgcacagaaagctgtagcaagtttatctgttaagcttgaacaagctatgaaggagattcagcgattgcaggaggacactgataaagccaacaagcaatcatctgtacttgagagagataatcgaagaatggaaatacaagtaaaagatctttcacaacagattagagtgcttttgatggaacttgaagaagcaaggggtaaccacgtaattcgtgatgaggaagtaagctctgctgatataagtagttcatctgaggtaatatcacagcatctagtatcttacagaaatattgaagagcttcaacaacaaaatcaacgtctcttagtggcccttagagagcttggggaaaccagagaaagagaagaacaagaaacaacttcatccaaaatcactgagcttcagctcaaacttgagagtgcccttactgaactagaacaactccgcaaatcacgacagcatcaaatgcagcttgttgattccatagttcgtcagcgtgatatgtaccgtattttattgtcacaaacaacaggagttgccattccattacatgcttcaagcttagatgatgtttctcttgcatcaactccaaaacgtccaagtacatcacagactgtttccactcctgctccagtacctgttattgaatcaacagaggctatagaggctaaggctgcccttaaacagttgcaggaaatttttgagaactacaaaaaagaaaaagcagaaaatgaaaaaatacaaaatgagcagcttgagaaacttcaagaacaagttacagatttgcgatcacaaaataccaaaatttctacccagctagattttgcttctaaacgttacttgtagaattacttttttcataccagttatgaaatgctgcaagataatgttgaaggatatcgtcgagaaataacatcacttcatgagagaaatcagaaactcactgccacaactcaaaagcaagaacagattatcaatacgatgactcaagatttgagaggagcaaatgagaagctagctgtcgcagaagtaagagcagaaaatttgaagaaggaaaaggaaatgcttaaattgtctgaagttcgtctttctcagcaaagagagtctttgttagctgaacaaagggggcaaaacttactgctaactaatctgcaaacaattcagggaatactggagcgatctgaaacagaaaccaaacaaaggcttagtagccagatagaaaaactggaacatgagatctctcatctaaagaagaagttggaaaatgaggtggaacaaaggcatacacttactagaaatctagatgttcaacttttagatacaaagagacaactggatacagagacaaatcttcatcttaacacaaaagaactattaaaaaatgctcaaaaagaaattgccacattgaaacagcacctcagtaatatggaagtccaagttgcttctcagtcttcacagagaactggtaaaggtcagcctagcaacaaagaagatgtggatgatcttgtgagtcagctaagacagacagaagagcaggtgaatgacttaaaggagagactcaaaacaagtacgagcaatgtggaacaatatcaagcaatggttactagtttagaagaatccctgaacaaggaaaaacaggtgacagaagaagtgcgtaagaatattgaagttcgtttaaaagagtcagctgaatttcagacacagttggaaaagaagttgatggaagtagagaaggaaaaacaagaacttcaggatgataaaagaagagccatagagagcatggaacaacagttatctgaattgaagaaaacactttctagtgttcagaatgaagtacaagaagctcttcagagagcaagcacagctttaagtaatgagcagcaagccagacgtgactgtcaggaacaagctaaaatagctgtggaagctcagaataagtatgagagagaattgatgctgcatgctgctgatgttgaagctctacaagctgcgaaggagcaggtttcaaaaatggcatcagtccgtcagcatttggaagaaacaacacagaaagcagaatcacagttgttggagtgtaaagcatcttgggaggaaagagagagaatgttaaaggatgaagtttccaaatgtgtatgtcgctgtgaagatctggagaaacaaaacagattacttcatgatcagatcgaaaaattaagtgacaaggtcgttgcctctgtgaaggaaggtgtacaaggtccactgaatgtatctctcagtgaagaaggaaaatctcaagaacaaattttggaaattctcagatttatacgacgagaaaaagaaattgctgaaactaggtttgaggtggctcaggttgagagtctgcgttatcgacaaagggttgaacttttagaaagagagctgcaggaactgcaagatagtctaaatgctgaaagggagaaagtccaggtaggtatactaagctttaagaaagcacttgttaaatcaaaagagaagcactcatttatatctctaccatttaacgtaatgtaaaatttaacttgaagtaagcattcttctaaacttgtaaattcattaagcatttgttaaacactaatatagtatagtgcttaaaagtaaaggctctgtaaccaaactgcctggtttcagattctagcttcataccattagctgtggccttgggtacattgtttaacttccctgctcttagtttcttcatctgtaatatttggataataatgaggtttaattgagtttgtgcacatgaagcatttagaagcatgtctggtatgtagtgggtgcttaataaattccagctatcttaatttattatagttatggattatacgtgtggatagtcattctaggataaagtgatttaaactgctacagaatatctttctcacccaaggagcaaaaagtagtaaaaactaacaaccaaaggaaaagaagctgtggtagtgaaatggatgataataagacaagcttgactccttaccccacactaccacccaaagcttattgttgagttacttcattcttaggagctacagtaatatacccccacctctagaaggaaggaaattaagatcttaaaacatttatcttcttttaactgatgagtagtcaaaatgactgttaagaagaaaccattgaacagggaaaagtaaataatgaattttatgggatttatgtgttcagcaaaagctaaaggttccagaattatatcctgtttaattcaaatgtatctcaccatggaaataatagagcctccagttcaatagagttaatacttggaggaaaagggacagaatcagagtctctaacaaagactgcatattgtttcagtcttttccgcttcattttttattcctttgggctatagaaagtaaatactagaaaatgcccgcctacgaatgagttcatagggggaaaccaactcttaaatacaggaagaagagagtcaacaagtaacatagattatataaaaaataatataatgggccgggcatggtggctcatgcctgtaatcccagcactttgggaggccgaggcgggtggatcacgaggttaggagattgagaccatcctggctaacacggtgaaaccccgtctctactaaaaatacaaaaaaattagctgggcatggtggtggcaggcacctgtagtcccagctactcgggaggctgaggcaggagaacggcgtaaatccgggaggcggagcttgcagtgagccgagatcacaccactggactccagtctgggcgacagagcgagactccgtctcaaaaaaaaaaaaaaattataatagnaatgtaatgtctgtctaagcatgaacagtgtagcatggcaaccangaaatatgctatagctttaaaaacagtgggggaagaaagtaataccaagtgcagaagatggataattataacctatgagaaggaaaaaattcttcacagataattcagtaaaatttctcatggccaaagtgatgaaacaatggatcaaaatgagagatttctgaacaagagggaataaactgaggattagaataacattttagaactaataaatttagtgcagcaaggaaaaaaagatacagaaaggtaaatagagatttggattaatgtttttacctaatgttaatactttgttggtgggatttgtagcatcttttcacttttgtctttgtaattcttgtatttgtttaaagtctgcagttcgcatgcctcncagaaaagtaaacgtgaactttcaanaattttagttctaaaagttgaaacttaaatcctctttattttgtcatagggaggatttgagctcataggaacaggtagactttcaactattgttagatgttggtatgtatatttatttgaaatgtttaggtaactgcaaaaacaatggctcagcatgaagaactgatgaagaaaactgaaacaatgaatgtagttatggagaccaataaaatgctaagagaagagaaggagagactagaacaggatctacagcaaatgcaagcaaaggtgaggaaactggagttagatattttacccttacaagaagcaaatgctgagctgagtgagaaaagcggtatgttgcaggcagagaagaagctcttagaagaggatgtcaaacgttggaaagcacgtaaccagcatctagtaagtcaacagaaagatccagatacagaagaatatcggaagctcctttctgaaaaggaagttcatactaagcgtattcaacaattgacagaagaaattggtagacttaaagctgaaattgcaagatcaaatgcatctttgactaacaaccagaacttaattcagagtctgaaggaagatctaaataaagtaagaactgaaaaggaaaccatccagaaggacttagatgccaaaataattgatatccaagaaaaagtcaaaactattactcaagttaagaaaattggacgtaggtacaagactcaatatgaagaacttaaagcacaacaggataaggttatggagacatcggctcagtcctctggagaccatcaggagcagcatgtttcagtccaggaaatgcaggaactcaaagaaacgctcaaccaagctgaaacaaaatcaaaatcacttgaaagtcaagtagagaatctgcagaagacattatctgaaaaagagacagaagcaagaaatctccaggaacagactgtgcaacttcagtctgaactttcacgacttcgtcaggatcttcaagatagaaccacacaggaggagcagctccgacaacagataactgaaaaggaagaaaaaaccagaaaggctattgtagcagcaaagtcaaaaattgcacacttagctggtgtaaaagatcagctaactaaagaaaatgaggagcttaaacaaaggaatggagccttagatcagcagaaagatgaattggatgttcgcattactgcgctaaagtcccaatatgaaggtcgaattagtcgcttggaaagagaactcagggagcatcaagagagacaccttgagcagagagatgagcctcaagaaccttctaataaggtccctgaacagcagagacagatcacattgaaaacaactccagcttctggtgaaagaggaattgccagcacatcagacccaccaacagccaatatcaagccaactcctgttgtgtctactccaagtaaagtgacagctgcagctatggctggaaataagtcaacacccagggctagtatccgcccaatggttacacctgcaactgttacaaatcccactactaccccaacagctacagtgatgcccactacacaagtggaatcacaggaagctatgcagtcagaagggcctgtggaacatgttccagtttttggaagcacaagtggatccgttcgttctactagtcctaatgtccagccttctatctctcaacctattttaactgttcagcaacaaacacaggctacagcttttgtgcaacccactcaacagagtcatcctcagattgagcctgccaatcaagagttatcttcaaacatagtagaggttgttcagagttcaccagttgagcggccttctacttccacagcagtatttggcacagtttcggctacccccagttcttctttgccaaagcgtacacgtgaagaggaagaggatagcaccatagaagcatcagaccaagtctctgatgatacagtggaaatgcctcttccaaagaagttgaaaagtgtcacacctgtaggaactgaggaagaagttatggcagaagaaagtactgatggagaggtagagactcaggtatacaaccaggattctcaagattccattggagaaggagttacccagggagattatacacctatggaagacagtgaagaaacctctcagtctctacaaatagatcttgggccacttcaatcagatcagcagacgacaacttcatcccaggatggtcaaggcaaaggagatgatgtcattgtaattgacagtgatgatgaagaagaggatgatgatgaaaatgatggagaacatgaggattatgaagaggatgaggaagatgatgatgatgatgaagatgacacagggatgggagatgagggtgaagatagtaatgaaggaactggtagtgccgatggcaatgatggttatgaagctgatgatgctgagggtggtgatgggactgatccaggtacagaaacagaagaaagtatgggtggaggtgaaggtaatcacagagctgctgattctcaaaacagtggtgaaggaaatacaggtgctgcagaatcttctttttctcaggaggtttctagagaacaacagccatcatcagcatctgaaagacaggcccctcgagcacctcagtcaccgagacgcccaccacatccacttcccccaagactgaccattcatgccccacctcaggagttgggaccaccagttcagagaattcagatgacccgaaggcagtctgtaggacgtggccttcagttgactccaggaataggtggcatgcaacagcatttttttgatgatgaagacagaacagttccaagtactccaactcttgtggtgccacatcgtactgatggatttgctgaagcaattcattcgccgcaggttgctggtgtccctagattccggtttgggccacctgaagatatgccacaaacaagttctagtcactctgatcttggccagcttgcttctcaaggaggtttaggaatgtatgaaacacccctgttcctagctcatgaagaagagtcaggtggccgaagtgttcccactactccactacaagtagcagccccagtgactgtatttactgagagcaccacctctgatgcttcggaacatgcctctcaatctgttccaatggtgactacatccactggcactttatctacaacaaatgaaacagcaacaggtgatgatggagatgaagtatttgtggaggcagaatctgaaggtattagttcagaagcaggcctagaaattgatagccagcaggaagaagagccggttcaagcatctgatgagtcagatctcccctccaccagccaggatcctccttctagctcatctgtagatactagtagtagtcaaccaaagcctttcagacgagtaagacttcagacaacattgagacaaggtgtccgtggtcgtcagtttaacagacagagaggtgtgagccatgcaatgggagggagaggaggaataaacagaggaaatattaattaaatggtctgtaaacaataacaactgtgaataagattatcaaatctgttttagtgtaatgattgtcaagtttaaaaacatttttatatataaactggtatactcatgtcaatattctttattaataaaatgtttttcagtgtcaaaatttattattcatttcttcattagttgactcctcctttgctcatcagtctaaggacagttgtaccagactttggataaggtctgcccagaacgagtagtaattgctcttgctgttctactaggcacatcaatgttatagtattgatctaaatggaagagaaaacatttttttagttaaaaagaaaacaatgcccaaactaaaaaataacttatgttgactattatgctcaaagacaatgtttatcattttaatagagatgtttttactaattaatttgaactttataacaaaaagaaaaacaattgcctagacttttcagcttttttgatgtttcaaaagattgacatttcaccatctttttgtaaaatcaggttcagctctcctttatgaagtaaacattaaagagtaaccaagtttgaaaaataatttacttggggttattccttttaaaaaatacatgccaatgtcattcatattatga

SEQ ID NO: 369596 - DNA, 9825 bp, Homo sapiens
  misc_feature (5441)..(5441): n is a, c, g, or t
  misc_feature (5486)..(5486): n is a, c, g, or t
  misc_feature (5859)..(5859): n is a, c, g, or t
  misc_feature (5885)..(5885): n is a, c, g, or t
gcgcaagaggatcagggatagcctctgagctcgggttcccagggttcgtagcttccaacggctgcgcgcgcacttcggtcgcgggcggtgaggtgctgttgctgaaacgctgccgctgagggtggactcgatttcccagggtcccgccgcgggagtctccggcgggcgggcgcgcgcgagccaccgagcgaggtgatagaggcggcggcccaggcgtctgggtcctgctggtcttcgcctttcttctccgcttctaccccgtcggccgctgccactggggtccctggccccaccgacatggcggcggtgttgcagcaagtcctggagcgcacggagctgaacaagctgcccaagtctgtccagaacaaacttgaaaagttccttgctgatcagcaatccgagatcgatggcctgaaggggcggcatgagaaatttaaggtggagagcgaacaacagtattttgaaatagaaaagaggttgtcccacagtcaggagagacttgtgaatgaaacccgagagtgtcaaagcttgcggcttgagctagagaaactcaacaatcaactgaaggcactaactgagaaaaacaaagaacttgaaattgctcaggatcgcaatattgccattcagagccaatttacaagaacaaaggaagaattagaagctgagaaaagagacttaattagaaccaatgagagactatctcaagaacttgaatacttaacagaggatgttaaacgtctgaatgaaaaacttaaagaaagcaatacaacaaagggtgaacttcagttaaaattggatgaacttcaagcttctgatgtttctgttaagtatcgagaaaaacgcttggagcaagaaaaggaattgctacatagtcagaatacatggctgaatacagagttgaaaaccaaaactgatgaacttctggctcttggaagagaaaaagggaatgagattctagagcttaaatgtaatcttgaaaataaaaaagaagaggtttctagactggaagaacaaatgaatggcttaaaaacatcaaatgaacatcttcaaaagcatgtggaggatctgttgaccaaattaaaagaggccaaggaacaacaggccagtatggaagagaaattccacaatgaattaaatgcccacataaaactttctaatttgtacaagagtgccgctgatgactcagaagcaaagagcaatgaactaacccgggcagtagaggaactacacaaacttttgaaagaagctggtgaagccaacaaagcaatacaagatcatcttctagaggtggagcaatccaaagatcaaatggaaaaagaaatgcttgagaaaatagggagattggagaaggaattagagaatgcaaatgaccttctttctgccacaaaacgtaaaggagccatattgtctgaagaagagcttgccgccatgtctcctactgcagcagctgtagctaagatagtgaaacctgggatgaaactaactgagctctataatgcttatgtggaaactcaggatcagttgcttttggagaaactagagaacaaaagaattaataagtacctagatgaaatagtgaaagaagtggaagccaaagcaccaattttgaaacgccagcgtgaggaatatgaacgtgcacagaaagctgtagcaagtttatctgttaagcttgaacaagctatgaaggagattcagcgattgcaggaggacactgataaagccaacaagcaatcatctgtacttgagagagataatcgaagaatggaaatacaagtaaaagatctttcacaacagattagagtgcttttgatggaacttgaagaagcaaggggtaaccacgtaattcgtgatgaggaagtaagctctgctgatataagtagttcatctgaggtaatatcacagcatctagtatcttacagaaatattgaagagcttcaacaacaaaatcaacgtctcttagtggcccttagagagcttggggaaaccagagaaagagaagaacaagaaacaacttcatccaaaatcactgagcttcagctcaaacttgagagtgcccttactgaactagaacaactccgcaaatcacgacagcatcaaatgcagcttgttgattccatagttcgtcagcgtgatatgtaccgtattttattgtcacaaacaacaggagttgccattccattacatgcttcaagcttagatgatgtttctcttgcatcaactccaaaacgtccaagtacatcacagactgtttccactcctgctccagtacctgttattgaatcaacagaggctatagaggctaaggctgcccttaaacagttgcaggaaatttttgagaactacaaaaaagaaaaagcagaaaatgaaaaaatacaaaatgagcagcttgagaaacttcaagaacaagttacagatttgcgatcacaaaataccaaaatttctacccagctagattttgcttctaaacgttacttgtagaattacttttttcataccagttatgaaatgctgcaagataatgttgaaggatatcgtcgagaaataacatcacttcatgagagaaatcagaaactcactgccacaactcaaaagcaagaacagattatcaatacgatgactcaagatttgagaggagcaaatgagaagctagctgtcgcagaagtaagagcagaaaatttgaagaaggaaaaggaaatgcttaaattgtctgaagttcgtctttctcagcaaagagagtctttgttagctgaacaaagggggcaaaacttactgctaactaatctgcaaacaattcagggaatactggagcgatctgaaacagaaaccaaacaaaggcttagtagccagatagaaaaactggaacatgagatctctcatctaaagaagaagttggaaaatgaggtggaacaaaggcatacacttactagaaatctagatgttcaacttttagatacaaagagacaactggatacagagacaaatcttcatcttaacacaaaagaactattaaaaaatgctcaaaaagaaattgccacattgaaacagcacctcagtaatatggaagtccaagttgcttctcagtcttcacagagaactggtaaaggtcagcctagcaacaaagaagatgtggatgatcttgtgagtcagctaagacagacagaagagcaggtgaatgacttaaaggagagactcaaaacaagtacgagcaatgtggaacaatatcaagcaatggttactagtttagaagaatccctgaacaaggaaaaacaggtgacagaagaagtgcgtaagaatattgaagttcgtttaaaagagtcagctgaatttcagacacagttggaaaagaagttgatggaagtagagaaggaaaaacaagaacttcaggatgataaaagaagagccatagagagcatggaacaacagttatctgaattgaagaaaacactttctagtgttcagaatgaagtacaagaagctcttcagagagcaagcacagctttaagtaatgagcagcaagccagacgtgactgtcaggaacaagctaaaatagctgtggaagctcagaataagtatgagagagaattgatgctgcatgctgctgatgttgaagctctacaagctgcgaaggagcaggtttcaaaaatggcatcagtccgtcagcatttggaagaaacaacacagaaagcagaatcacagttgttggagtgtaaagcatcttgggaggaaagagagagaatgttaaaggatgaagtttccaaatgtgtatgtcgctgtgaagatctggagaaacaaaacagattacttcatgatcagatcgaaaaattaagtgacaaggtcgttgcctctgtgaaggaaggtgtacaaggtccactgaatgtatctctcagtgaagaaggaaaatctcaagaacaaattttggaaattctcagatttatacgacgagaaaaagaaattgctgaaactaggtttgaggtggctcaggttgagagtctgcgttatcgacaaagggttgaacttttagaaagagagctgcaggaactgcaagatagtctaaatgctgaaagggagaaagtccaggtaggtatactaagctttaagaaagcacttgttaaatcaaaagagaagcactcatttatatctctaccatttaacgtaatgtaaaatttaacttgaagtaagcattcttctaaacttgtaaattcattaagcatttgttaaacactaatatagtatagtgcttaaaagtaaaggctctgtaaccaaactgcctggtttcagattctagcttcataccattagctgtggccttgggtacattgtttaacttccctgctcttagtttcttcatctgtaatatttggataataatgaggtttaattgagtttgtgcacatgaagcatttagaagcatgtctggtatgtagtgggtgcttaataaattccagctatcttaatttattatagttatggattatacgtgtggatagtcattctaggataaagtgatttaaactgctacagaatatctttctcacccaaggagcaaaaagtagtaaaaactaacaaccaaaggaaaagaagctgtggtagtgaaatggatgataataagacaagcttgactccttaccccacactaccacccaaagcttattgttgagttacttcattcttaggagctacagtaatatacccccacctctagaaggaaggaaattaagatcttaaaacatttatcttcttttaactgatgagtagtcaaaatgactgttaagaagaaaccattgaacagggaaaagtaaataatgaattttatgggatttatgtgttcagcaaaagctaaaggttccagaattatatcctgtttaattcaaatgtatctcaccatggaaataatagagcctccagttcaatagagttaatacttggaggaaaagggacagaatcagagtctctaacaaagactgcatattgtttcagtcttttccgcttcattttttattcctttgggctatagaaagtaaatactagaaaatgcccgcctacgaatgagttcatagggggaaaccaactcttaaatacaggaagaagagagtcaacaagtaacatagattatataaaaaataatataatgggccgggcatggtggctcatgcctgtaatcccagcactttgggaggccgaggcgggtggatcacgaggttaggagattgagaccatcctggctaacacggtgaaaccccgtctctactaaaaatacaaaaaaattagctgggcatggtggtggcaggcacctgtagtcccagctactcgggaggctgaggcaggagaacggcgtaaatccgggaggcggagcttgcagtgagccgagatcacaccactggactccagtctgggcgacagagcgagactccgtctcaaaaaaaaaaaaaaattataatagnaatgtaatgtctgtctaagcatgaacagtgtagcatggcaaccangaaatatgctatagctttaaaaacagtgggggaagaaagtaataccaagtgcagaagatggataattataacctatgagaaggaaaaaattcttcacagataattcagtaaaatttctcatggccaaagtgatgaaacaatggatcaaaatgagagatttctgaacaagagggaataaactgaggattagaataacattttagaactaataaatttagtgcagcaaggaaaaaaagatacagaaaggtaaatagagatttggattaatgtttttacctaatgttaatactttgttggtgggatttgtagcatcttttcacttttgtctttgtaattcttgtatttgtttaaagtctgcagttcgcatgcctcncagaaaagtaaacgtgaactttcaanaattttagttctaaaagttgaaacttaaatcctctttattttgtcatagggaggatttgagctcataggaacaggtagactttcaactattgttagatgttggtatgtatatttatttgaaatgtttaggtaactgcaaaaacaatggctcagcatgaagaactgatgaagaaaactgaaacaatgaatgtagttatggagaccaataaaatgctaagagaagagaaggagagactagaacaggatctacagcaaatgcaagcaaaggtgaggaaactggagttagatattttacccttacaagaagcaaatgctgagctgagtgagaaaagcggtatgttgcaggcagagaagaagctcttagaagaggatgtcaaacgttggaaagcacgtaaccagcatctagtaagtcaacagaaagatccagatacagaagaatatcggaagctcctttctgaaaaggaagttcatactaagcgtattcaacaattgacagaagaaattggtagacttaaagctgaaattgcaagatcaaatgcatctttgactaacaaccagaacttaattcagagtctgaaggaagatctaaataaagtaagaactgaaaaggaaaccatccagaaggacttagatgccaaaataattgatatccaagaaaaagtcaaaactattactcaagttaagaaaattggacgtaggtacaagactcaatatgaagaacttaaagcacaacaggataaggttatggagacatcggctcagtcctctggagaccatcaggagcagcatgtttcagtccaggaaatgcaggaactcaaagaaacgctcaaccaagctgaaacaaaatcaaaatcacttgaaagtcaagtagagaatctgcagaagacattatctgaaaaagagacagaagcaagaaatctccaggaacagactgtgcaacttcagtctgaactttcacgacttcgtcaggatcttcaagatagaaccacacaggaggagcagctccgacaacagataactgaaaaggaagaaaaaaccagaaaggctattgtagcagcaaagtcaaaaattgcacacttagctggtgtaaaagatcagctaactaaagaaaatgaggagcttaaacaaaggaatggagccttagatcagcagaaagatgaattggatgttcgcattactgcgctaaagtcccaatatgaaggtcgaattagtcgcttggaaagagaactcagggagcatcaagagagacaccttgagcagagagatgagcctcaagaaccttctaataaggtccctgaacagcagagacagatcacattgaaaacaactccagcttctggtgaaagaggaattgccagcacatcagacccaccaacagccaatatcaagccaactcctgttgtgtctactccaagtaaagtgacagctgcagctatggctggaaataagtcaacacccagggctagtatccgcccaatggttacacctgcaactgttacaaatcccactactaccccaacagctacagtgatgcccactacacaagtggaatcacaggaagctatgcagtcagaagggcctgtggaacatgttccagtttttggaagcacaagtggatccgttcgttctactagtcctaatgtccagccttctatctctcaacctattttaactgttcagcaacaaacacaggctacagcttttgtgcaacccactcaacagagtcatcctcagattgagcctgccaatcaagagttatcttcaaacatagtagaggttgttcagagttcaccagttgagcggccttctacttccacagcagtatttggcacagtttcggctacccccagttcttctttgccaaagcgtacacgtgaagaggaagaggatagcaccatagaagcatcagaccaagtctctgatgatacagtggaaatgcctcttccaaagaagttgaaaagtgtcacacctgtaggaactgaggaagaagttatggcagaagaaagtactgatggagaggtagagactcaggtatacaaccaggattctcaagattccattggagaaggagttacccagggagattatacacctatggaagacagtgaagaaacctctcagtctctacaaatagatcttgggccacttcaatcagatcagcagacgacaacttcatcccaggatggtcaaggcaaaggagatgatgtcattgtaattgacagtgatgatgaagaagaggatgatgatgaaaatgatggagaacatgaggattatgaagaggatgaggaagatgatgatgatgatgaagatgacacagggatgggagatgagggtgaagatagtaatgaaggaactggtagtgccgatggcaatgatggttatgaagctgatgatgctgagggtggtgatgggactgatccaggtacagaaacagaagaaagtatgggtggaggtgaaggtaatcacagagctgctgattctcaaaacagtggtgaaggaaatacaggtgctgcagaatcttctttttctcaggaggtttctagagaacaacagccatcatcagcatctgaaagacaggcccctcgagcacctcagtcaccgagacgcccaccacatccacttcccccaagactgaccattcatgccccacctcaggagttgggaccaccagttcagagaattcagatgacccgaaggcagtctgtaggacgtggccttcagttgactccaggaataggtggcatgcaacagcatttttttgatgatgaagacagaacagttccaagtactccaactcttgtggtgccacatcgtactgatggatttgctgaagcaattcattcgccgcaggttgctggtgtccctagattccggtttgggccacctgaagatatgccacaaacaagttctagtcactctgatcttggccagcttgcttctcaaggaggtttaggaatgtatgaaacacccctgttcctagctcatgaagaagagtcaggtggccgaagtgttcccactactccactacaagtagcagccccagtattagttcagaagcaggcctagaaattgatagccagcaggaagaagagccggttcaagcatctgatgagtcagatctcccctccaccagccaggatcctccttctagctcatctgtagatactagtagtagtcaaccaaagcctttcagacgagtaagacttcagacaacattgagacaaggtgtccgtggtcgtcagtttaacagacagagaggtgtgagccatgcaatgggagggagaggaggaataaacagaggaaatattaattaaatggtctgtaaacaataacaactgtgaataagattatcaaatctgttttagtgtaatgattgtcaagtttaaaaacatttttatatataaactggtatactcatgtcaatattctttattaataaaatgtttttcagtgtcaaaatttattattcatttcttcattagttgactcctcctttgctcatcagtctaaggacagttgtaccagactttggataaggtctgcccagaacgagtagtaattgctcttgctgttctactaggcacatcaatgttatagtattgatctaaatggaagagaaaacatttttttagttaaaaagaaaacaatgcccaaactaaaaaataacttatgttgactattatgctcaaagacaatgtttatcattttaatagagatgtttttactaattaatttgaactttataacaaaaagaaaaacaattgcctagacttttcagcttttttgatgtttcaaaagattgacatttcaccatctttttgtaaaatcaggttcagctctcctttatgaagtaaacattaaagagtaaccaagtttgaaaaataatttacttggggttattccttttaaaaaatacatgccaatgtcattcatattatga

SEQ ID NO: 369597 - DNA, 8461 bp, Homo sapiens
  misc_feature (5441)..(5441): n is a, c, g, or t
  misc_feature (5486)..(5486): n is a, c, g, or t
  misc_feature (5859)..(5859): n is a, c, g, or t
  misc_feature (5885)..(5885): n is a, c, g, or t
gcgcaagaggatcagggatagcctctgagctcgggttcccagggttcgtagcttccaacggctgcgcgcgcacttcggtcgcgggcggtgaggtgctgttgctgaaacgctgccgctgagggtggactcgatttcccagggtcccgccgcgggagtctccggcgggcgggcgcgcgcgagccaccgagcgaggtgatagaggcggcggcccaggcgtctgggtcctgctggtcttcgcctttcttctccgcttctaccccgtcggccgctgccactggggtccctggccccaccgacatggcggcggtgttgcagcaagtcctggagcgcacggagctgaacaagctgcccaagtctgtccagaacaaacttgaaaagttccttgctgatcagcaatccgagatcgatggcctgaaggggcggcatgagaaatttaaggtggagagcgaacaacagtattttgaaatagaaaagaggttgtcccacagtcaggagagacttgtgaatgaaacccgagagtgtcaaagcttgcggcttgagctagagaaactcaacaatcaactgaaggcactaactgagaaaaacaaagaacttgaaattgctcaggatcgcaatattgccattcagagccaatttacaagaacaaaggaagaattagaagctgagaaaagagacttaattagaaccaatgagagactatctcaagaacttgaatacttaacagaggatgttaaacgtctgaatgaaaaacttaaagaaagcaatacaacaaagggtgaacttcagttaaaattggatgaacttcaagcttctgatgtttctgttaagtatcgagaaaaacgcttggagcaagaaaaggaattgctacatagtcagaatacatggctgaatacagagttgaaaaccaaaactgatgaacttctggctcttggaagagaaaaagggaatgagattctagagcttaaatgtaatcttgaaaataaaaaagaagaggtttctagactggaagaacaaatgaatggcttaaaaacatcaaatgaacatcttcaaaagcatgtggaggatctgttgaccaaattaaaagaggccaaggaacaacaggccagtatggaagagaaattccacaatgaattaaatgcccacataaaactttctaatttgtacaagagtgccgctgatgactcagaagcaaagagcaatgaactaacccgggcagtagaggaactacacaaacttttgaaagaagctggtgaagccaacaaagcaatacaagatcatcttctagaggtggagcaatccaaagatcaaatggaaaaagaaatgcttgagaaaatagggagattggagaaggaattagagaatgcaaatgaccttctttctgccacaaaacgtaaaggagccatattgtctgaagaagagcttgccgccatgtctcctactgcagcagctgtagctaagatagtgaaacctgggatgaaactaactgagctctataatgcttatgtggaaactcaggatcagttgcttttggagaaactagagaacaaaagaattaataagtacctagatgaaatagtgaaagaagtggaagccaaagcaccaattttgaaacgccagcgtgaggaatatgaacgtgcacagaaagctgtagcaagtttatctgttaagcttgaacaagctatgaaggagattcagcgattgcaggaggacactgataaagccaacaagcaatcatctgtacttgagagagataatcgaagaatggaaatacaagtaaaagatctttcacaacagattagagtgcttttgatggaacttgaagaagcaaggggtaaccacgtaattcgtgatgaggaagtaagctctgctgatataagtagttcatctgaggtaatatcacagcatctagtatcttacagaaatattgaagagcttcaacaacaaaatcaacgtctcttagtggcccttagagagcttggggaaaccagagaaagagaagaacaagaaacaacttcatccaaaatcactgagcttcagctcaaacttgagagtgcccttactgaactagaacaactccgcaaatcacgacagcatcaaatgcagcttgttgattccatagttcgtcagcgtgatatgtaccgtattttattgtcacaaacaacaggagttgccattccattacatgcttcaagcttagatgatgtttctcttgcatcaactccaaaacgtccaagtacatcacagactgtttccactcctgctccagtacctgttattgaatcaacagaggctatagaggctaaggctgcccttaaacagttgcaggaaatttttgagaactacaaaaaagaaaaagcagaaaatgaaaaaatacaaaatgagcagcttgagaaacttcaagaacaagttacagatttgcgatcacaaaataccaaaatttctacccagctagattttgcttctaaacgttacttgtagaattacttttttcataccagttatgaaatgctgcaagataatgttgaaggatatcgtcgagaaataacatcacttcatgagagaaatcagaaactcactgccacaactcaaaagcaagaacagattatcaatacgatgactcaagatttgagaggagcaaatgagaagctagctgtcgcagaagtaagagcagaaaatttgaagaaggaaaaggaaatgcttaaattgtctgaagttcgtctttctcagcaaagagagtctttgttagctgaacaaagggggcaaaacttactgctaactaatctgcaaacaattcagggaatactggagcgatctgaaacagaaaccaaacaaaggcttagtagccagatagaaaaactggaacatgagatctctcatctaaagaagaagttggaaaatgaggtggaacaaaggcatacacttactagaaatctagatgttcaacttttagatacaaagagacaactggatacagagacaaatcttcatcttaacacaaaagaactattaaaaaatgctcaaaaagaaattgccacattgaaacagcacctcagtaatatggaagtccaagttgcttctcagtcttcacagagaactggtaaaggtcagcctagcaacaaagaagatgtggatgatcttgtgagtcagctaagacagacagaagagcaggtgaatgacttaaaggagagactcaaaacaagtacgagcaatgtggaacaatatcaagcaatggttactagtttagaagaatccctgaacaaggaaaaacaggtgacagaagaagtgcgtaagaatattgaagttcgtttaaaagagtcagctgaatttcagacacagttggaaaagaagttgatggaagtagagaaggaaaaacaagaacttcaggatgataaaagaagagccatagagagcatggaacaacagttatctgaattgaagaaaacactttctagtgttcagaatgaagtacaagaagctcttcagagagcaagcacagctttaagtaatgagcagcaagccagacgtgactgtcaggaacaagctaaaatagctgtggaagctcagaataagtatgagagagaattgatgctgcatgctgctgatgttgaagctctacaagctgcgaaggagcaggtttcaaaaatggcatcagtccgtcagcatttggaagaaacaacacagaaagcagaatcacagttgttggagtgtaaagcatcttgggaggaaagagagagaatgttaaaggatgaagtttccaaatgtgtatgtcgctgtgaagatctggagaaacaaaacagattacttcatgatcagatcgaaaaattaagtgacaaggtcgttgcctctgtgaaggaaggtgtacaaggtccactgaatgtatctctcagtgaagaaggaaaatctcaagaacaaattttggaaattctcagatttatacgacgagaaaaagaaattgctgaaactaggtttgaggtggctcaggttgagagtctgcgttatcgacaaagggttgaacttttagaaagagagctgcaggaactgcaagatagtctaaatgctgaaagggagaaagtccaggtaggtatactaagctttaagaaagcacttgttaaatcaaaagagaagcactcatttatatctctaccatttaacgtaatgtaaaatttaacttgaagtaagcattcttctaaacttgtaaattcattaagcatttgttaaacactaatatagtatagtgcttaaaagtaaaggctctgtaaccaaactgcctggtttcagattctagcttcataccattagctgtggccttgggtacattgtttaacttccctgctcttagtttcttcatctgtaatatttggataataatgaggtttaattgagtttgtgcacatgaagcatttagaagcatgtctggtatgtagtgggtgcttaataaattccagctatcttaatttattatagttatggattatacgtgtggatagtcattctaggataaagtgatttaaactgctacagaatatctttctcacccaaggagcaaaaagtagtaaaaactaacaaccaaaggaaaagaagctgtggtagtgaaatggatgataataagacaagcttgactccttaccccacactaccacccaaagcttattgttgagttacttcattcttaggagctacagtaatatacccccacctctagaaggaaggaaattaagatcttaaaacatttatcttcttttaactgatgagtagtcaaaatgactgttaagaagaaaccattgaacagggaaaagtaaataatgaattttatgggatttatgtgttcagcaaaagctaaaggttccagaattatatcctgtttaattcaaatgtatctcaccatggaaataatagagcctccagttcaatagagttaatacttggaggaaaagggacagaatcagagtctctaacaaagactgcatattgtttcagtcttttccgcttcattttttattcctttgggctatagaaagtaaatactagaaaatgcccgcctacgaatgagttcatagggggaaaccaactcttaaatacaggaagaagagagtcaacaagtaacatagattatataaaaaataatataatgggccgggcatggtggctcatgcctgtaatcccagcactttgggaggccgaggcgggtggatcacgaggttaggagattgagaccatcctggctaacacggtgaaaccccgtctctactaaaaatacaaaaaaattagctgggcatggtggtggcaggcacctgtagtcccagctactcgggaggctgaggcaggagaacggcgtaaatccgggaggcggagcttgcagtgagccgagatcacaccactggactccagtctgggcgacagagcgagactccgtctcaaaaaaaaaaaaaaattataatagnaatgtaatgtctgtctaagcatgaacagtgtagcatggcaaccangaaatatgctatagctttaaaaacagtgggggaagaaagtaataccaagtgcagaagatggataattataacctatgagaaggaaaaaattcttcacagataattcagtaaaatttctcatggccaaagtgatgaaacaatggatcaaaatgagagatttctgaacaagagggaataaactgaggattagaataacattttagaactaataaatttagtgcagcaaggaaaaaaagatacagaaaggtaaatagagatttggattaatgtttttacctaatgttaatactttgttggtgggatttgtagcatcttttcacttttgtctttgtaattcttgtatttgtttaaagtctgcagttcgcatgcctcncagaaaagtaaacgtgaactttcaanaattttagttctaaaagttgaaacttaaatcctctttattttgtcatagggaggatttgagctcataggaacaggtagactttcaactattgttagatgttggtatgtatatttatttgaaatgtttaggtaactgcaaaaacaatggctcagcatgaagaactgatgaagaaaactgaaacaatgaatgtagttatggagaccaataaaatgctaagagaagagaaggagagactagaacaggatctacagcaaatgcaagcaaaggtgaggaaactggagttagatattttacccttacaagaagcaaatgctgagctgagtgagaaaagcggtatgttgcaggcagagaagaagctcttagaagaggatgtcaaacgttggaaagcacgtaaccagcatctagtaagtcaacagaaagatccagatacagaagaatatcggaagctcctttctgaaaaggaagttcatactaagcgtattcaacaattgacagaagaaattggtagacttaaagctgaaattgcaagatcaaatgcatctttgactaacaaccagaacttaattcagagtctgaaggaagatctaaataaagtaagaactgaaaaggaaaccatccagaaggacttagatgccaaaataattgatatccaagaaaaagtcaaaactattactcaagttaagaaaattggacgtaggtacaagactcaatatgaagaacttaaagcacaacaggataaggttatggagacatcggctcagtcctctggagaccatcaggagcagcatgtttcagtccaggaaatgcaggaactcaaagaaacgctcaaccaagctgaaacaaaatcaaaatcacttgaaagtcaagtagagaatctgcagaagacattatctgaaaaagagacagaagcaagaaatctccaggaacagactgtgcaacttcagtctgaactttcacgacttcgtcaggatcttcaagatagaaccacacaggaggagcagctccgacaacagataactgaaaaggaagaaaaaaccagaaaggctattgtagcagcaaagtcaaaaattgcacacttagctggtgtaaaagatcagctaactaaagaaaatgaggagcttaaacaaaggaatggagccttagatcagcagaaagatgaattggatgttcgcattactgcgctaaagtcccaatatgaaggtcgaattagtcgcttggaaagagaactcagggagcatcaagagagacaccttgagcagagagatgagcctcaagaaccttctaataaggtccctgaacagcagagacagatcacattgaaaacaactccagcttctggtgaaagaggaattgccagcacatcagacccaccaacagccaatatcaagccaactcctgttgtgtctactccaagtaaagtgacagctgcagctatggctggaaataagtcaacacccagggctagtatccgcccaatggttacacctgcaactgttacaaatcccactactaccccaacagctacagtgatgcccactacacaagtggaatcacaggaagctatgcagtcagaagggcctgtggaacatgttccagtttttggaagcacaagtggatccgttcgttctactagtcctaatgtccagccttctatctctcaacctattttaactgttcagcaacaaacacaggctacagcttttgtgcaacccactcaacagagtcatcctcagattgagcctgccaatcaagagttatcttcaaacatagtagaggttgttcagagttcaccagttgagcggccttctacttccacagcagtatttggcacagtttcggctacccccagttcttctttgccaaagcgtacacgtgaagaggaagaggatagcaccatagaagcatcagaccaagtctctgatgatacagtggaaatgcctcttccaaagaagttgaaaagtgtcacacctgtaggaactgaggaagaagttatggcagaagaaagtactgatggagaggtagagactcaggtatacaaccaggattctcaagattccattggagaaggagttacccagggagattatacacctatggaagacagtgaagaaacctctcagtctctacaaatagatcttgggccacttcaatcagatcagcagacgacaacttcatcccaggatggtcaaggcaaaggagatgatgtcattgtaattgacagtgatgatgaagaagaggatgatgatgaaaatgatggagaacatgaggattatgaagaggatgaggaagatgatgatgatgatgaagatgacacagggatgggagatgagggtgaagatagtaatgaaggaactggtagtgccgatggcaatgatggttatgaagctgatgatgctgagggtggtgatgggactgatccaggtacagaatgcccttcatgcctccacctgtttgctgtagctgtgcacatgtggttcctggttcttgagaattcttcccctcctctgcctcctgaccatcccgtccctttcatgctgtcttctcgcttttatgcctgctgtccgcgttcgtcctg

SEQ ID NO: 369598 - DNA, 7816 bp, Homo sapiens
  misc_feature (5441)..(5441): n is a, c, g, or t
  misc_feature (5486)..(5486): n is a, c, g, or t
  misc_feature (5859)..(5859): n is a, c, g, or t
  misc_feature (5885)..(5885): n is a, c, g, or t
gcgcaagaggatcagggatagcctctgagctcgggttcccagggttcgtagcttccaacggctgcgcgcgcacttcggtcgcgggcggtgaggtgctgttgctgaaacgctgccgctgagggtggactcgatttcccagggtcccgccgcgggagtctccggcgggcgggcgcgcgcgagccaccgagcgaggtgatagaggcggcggcccaggcgtctgggtcctgctggtcttcgcctttcttctccgcttctaccccgtcggccgctgccactggggtccctggccccaccgacatggcggcggtgttgcagcaagtcctggagcgcacggagctgaacaagctgcccaagtctgtccagaacaaacttgaaaagttccttgctgatcagcaatccgagatcgatggcctgaaggggcggcatgagaaatttaaggtggagagcgaacaacagtattttgaaatagaaaagaggttgtcccacagtcaggagagacttgtgaatgaaacccgagagtgtcaaagcttgcggcttgagctagagaaactcaacaatcaactgaaggcactaactgagaaaaacaaagaacttgaaattgctcaggatcgcaatattgccattcagagccaatttacaagaacaaaggaagaattagaagctgagaaaagagacttaattagaaccaatgagagactatctcaagaacttgaatacttaacagaggatgttaaacgtctgaatgaaaaacttaaagaaagcaatacaacaaagggtgaacttcagttaaaattggatgaacttcaagcttctgatgtttctgttaagtatcgagaaaaacgcttggagcaagaaaaggaattgctacatagtcagaatacatggctgaatacagagttgaaaaccaaaactgatgaacttctggctcttggaagagaaaaagggaatgagattctagagcttaaatgtaatcttgaaaataaaaaagaagaggtttctagactggaagaacaaatgaatggcttaaaaacatcaaatgaacatcttcaaaagcatgtggaggatctgttgaccaaattaaaagaggccaaggaacaacaggccagtatggaagagaaattccacaatgaattaaatgcccacataaaactttctaatttgtacaagagtgccgctgatgactcagaagcaaagagcaatgaactaacccgggcagtagaggaactacacaaacttttgaaagaagctggtgaagccaacaaagcaatacaagatcatcttctagaggtggagcaatccaaagatcaaatggaaaaagaaatgcttgagaaaatagggagattggagaaggaattagagaatgcaaatgaccttctttctgccacaaaacgtaaaggagccatattgtctgaagaagagcttgccgccatgtctcctactgcagcagctgtagctaagatagtgaaacctgggatgaaactaactgagctctataatgcttatgtggaaactcaggatcagttgcttttggagaaactagagaacaaaagaattaataagtacctagatgaaatagtgaaagaagtggaagccaaagcaccaattttgaaacgccagcgtgaggaatatgaacgtgcacagaaagctgtagcaagtttatctgttaagcttgaacaagctatgaaggagattcagcgattgcaggaggacactgataaagccaacaagcaatcatctgtacttgagagagataatcgaagaatggaaatacaagtaaaagatctttcacaacagattagagtgcttttgatggaacttgaagaagcaaggggtaaccacgtaattcgtgatgaggaagtaagctctgctgatataagtagttcatctgaggtaatatcacagcatctagtatcttacagaaatattgaagagcttcaacaacaaaatcaacgtctcttagtggcccttagagagcttggggaaaccagagaaagagaagaacaagaaacaacttcatccaaaatcactgagcttcagctcaaacttgagagtgcccttactgaactagaacaactccgcaaatcacgacagcatcaaatgcagcttgttgattccatagttcgtcagcgtgatatgtaccgtattttattgtcacaaacaacaggagttgccattccattacatgcttcaagcttagatgatgtttctcttgcatcaactccaaaacgtccaagtacatcacagactgtttccactcctgctccagtacctgttattgaatcaacagaggctatagaggctaaggctgcccttaaacagttgcaggaaatttttgagaactacaaaaaagaaaaagcagaaaatgaaaaaatacaaaatgagcagcttgagaaacttcaagaacaagttacagatttgcgatcacaaaataccaaaatttctacccagctagattttgcttctaaacgttacttgtagaattacttttttcataccagttatgaaatgctgcaagataatgttgaaggatatcgtcgagaaataacatcacttcatgagagaaatcagaaactcactgccacaactcaaaagcaagaacagattatcaatacgatgactcaagatttgagaggagcaaatgagaagctagctgtcgcagaagtaagagcagaaaatttgaagaaggaaaaggaaatgcttaaattgtctgaagttcgtctttctcagcaaagagagtctttgttagctgaacaaagggggcaaaacttactgctaactaatctgcaaacaattcagggaatactggagcgatctgaaacagaaaccaaacaaaggcttagtagccagatagaaaaactggaacatgagatctctcatctaaagaagaagttggaaaatgaggtggaacaaaggcatacacttactagaaatctagatgttcaacttttagatacaaagagacaactggatacagagacaaatcttcatcttaacacaaaagaactattaaaaaatgctcaaaaagaaattgccacattgaaacagcacctcagtaatatggaagtccaagttgcttctcagtcttcacagagaactggtaaaggtcagcctagcaacaaagaagatgtggatgatcttgtgagtcagctaagacagacagaagagcaggtgaatgacttaaaggagagactcaaaacaagtacgagcaatgtggaacaatatcaagcaatggttactagtttagaagaatccctgaacaaggaaaaacaggtgacagaagaagtgcgtaagaatattgaagttcgtttaaaagagtcagctgaatttcagacacagttggaaaagaagttgatggaagtagagaaggaaaaacaagaacttcaggatgataaaagaagagccatagagagcatggaacaacagttatctgaattgaagaaaacactttctagtgttcagaatgaagtacaagaagctcttcagagagcaagcacagctttaagtaatgagcagcaagccagacgtgactgtcaggaacaagctaaaatagctgtggaagctcagaataagtatgagagagaattgatgctgcatgctgctgatgttgaagctctacaagctgcgaaggagcaggtttcaaaaatggcatcagtccgtcagcatttggaagaaacaacacagaaagcagaatcacagttgttggagtgtaaagcatcttgggaggaaagagagagaatgttaaaggatgaagtttccaaatgtgtatgtcgctgtgaagatctggagaaacaaaacagattacttcatgatcagatcgaaaaattaagtgacaaggtcgttgcctctgtgaaggaaggtgtacaaggtccactgaatgtatctctcagtgaagaaggaaaatctcaagaacaaattttggaaattctcagatttatacgacgagaaaaagaaattgctgaaactaggtttgaggtggctcaggttgagagtctgcgttatcgacaaagggttgaacttttagaaagagagctgcaggaactgcaagatagtctaaatgctgaaagggagaaagtccaggtaggtatactaagctttaagaaagcacttgttaaatcaaaagagaagcactcatttatatctctaccatttaacgtaatgtaaaatttaacttgaagtaagcattcttctaaacttgtaaattcattaagcatttgttaaacactaatatagtatagtgcttaaaagtaaaggctctgtaaccaaactgcctggtttcagattctagcttcataccattagctgtggccttgggtacattgtttaacttccctgctcttagtttcttcatctgtaatatttggataataatgaggtttaattgagtttgtgcacatgaagcatttagaagcatgtctggtatgtagtgggtgcttaataaattccagctatcttaatttattatagttatggattatacgtgtggatagtcattctaggataaagtgatttaaactgctacagaatatctttctcacccaaggagcaaaaagtagtaaaaactaacaaccaaaggaaaagaagctgtggtagtgaaatggatgataataagacaagcttgactccttaccccacactaccacccaaagcttattgttgagttacttcattcttaggagctacagtaatatacccccacctctagaaggaaggaaattaagatcttaaaacatttatcttcttttaactgatgagtagtcaaaatgactgttaagaagaaaccattgaacagggaaaagtaaataatgaattttatgggatttatgtgttcagcaaaagctaaaggttccagaattatatcctgtttaattcaaatgtatctcaccatggaaataatagagcctccagttcaatagagttaatacttggaggaaaagggacagaatcagagtctctaacaaagactgcatattgtttcagtcttttccgcttcattttttattcctttgggctatagaaagtaaatactagaaaatgcccgcctacgaatgagttcatagggggaaaccaactcttaaatacaggaagaagagagtcaacaagtaacatagattatataaaaaataatataatgggccgggcatggtggctcatgcctgtaatcccagcactttgggaggccgaggcgggtggatcacgaggttaggagattgagaccatcctggctaacacggtgaaaccccgtctctactaaaaatacaaaaaaattagctgggcatggtggtggcaggcacctgtagtcccagctactcgggaggctgaggcaggagaacggcgtaaatccgggaggcggagcttgcagtgagccgagatcacaccactggactccagtctgggcgacagagcgagactccgtctcaaaaaaaaaaaaaaattataatagnaatgtaatgtctgtctaagcatgaacagtgtagcatggcaaccangaaatatgctatagctttaaaaacagtgggggaagaaagtaataccaagtgcagaagatggataattataacctatgagaaggaaaaaattcttcacagataattcagtaaaatttctcatggccaaagtgatgaaacaatggatcaaaatgagagatttctgaacaagagggaataaactgaggattagaataacattttagaactaataaatttagtgcagcaaggaaaaaaagatacagaaaggtaaatagagatttggattaatgtttttacctaatgttaatactttgttggtgggatttgtagcatcttttcacttttgtctttgtaattcttgtatttgtttaaagtctgcagttcgcatgcctcncagaaaagtaaacgtgaactttcaanaattttagttctaaaagttgaaacttaaatcctctttattttgtcatagggaggatttgagctcataggaacaggtagactttcaactattgttagatgttggtatgtatatttatttgaaatgtttaggtaactgcaaaaacaatggctcagcatgaagaactgatgaagaaaactgaaacaatgaatgtagttatggagaccaataaaatgctaagagaagagaaggagagactagaacaggatctacagcaaatgcaagcaaaggtgaggaaactggagttagatattttacccttacaagaagcaaatgctgagctgagtgagaaaagcggtatgttgcaggcagagaagaagctcttagaagaggatgtcaaacgttggaaagcacgtaaccagcatctagtaagtcaacagaaagatccagatacagaagaatatcggaagctcctttctgaaaaggaagttcatactaagcgtattcaacaattgacagaagaaattggtagacttaaagctgaaattgcaagatcaaatgcatctttgactaacaaccagaacttaattcagagtctgaaggaagatctaaataaagtaagaactgaaaaggaaaccatccagaaggacttagatgccaaaataattgatatccaagaaaaagtcaaaactattactcaagttaagaaaattggacgtaggtacaagactcaatatgaagaacttaaagcacaacaggataaggttatggagacatcggctcagtcctctggagaccatcaggagcagcatgtttcagtccaggaaatgcaggaactcaaagaaacgctcaaccaagctgaaacaaaatcaaaatcacttgaaagtcaagtagagaatctgcagaagacattatctgaaaaagagacagaagcaagaaatctccaggaacagactgtgcaacttcagtctgaactttcacgacttcgtcaggatcttcaagatagaaccacacaggaggagcagctccgacaacagataactgaaaaggaagaaaaaaccagaaaggctattgtagcagcaaagtcaaaaattgcacacttagctggtgtaaaagatcagctaactaaagaaaatgaggagcttaaacaaaggaatggagccttagatcagcagaaagatgaattggatgttcgcattactgcgctaaagtcccaatatgaaggtcgaattagtcgcttggaaagagaactcagggagcatcaagagagacaccttgagcagagagatgagcctcaagaaccttctaataaggtccctgaacagcagagacagatcacattgaaaacaactccagcttctggtgaaagaggaattgccagcacatcagacccaccaacagccaatatcaagccaactcctgttgtgtctactccaagtaaagtgacagctgcagctatggctggaaataagtcaacacccagggctagtatccgcccaatggttacacctgcaactgttacaaatcccactactaccccaacagctacagtgatgcccactacacaagtggaatcacaggaagctatgcagtcagaagggcctgtggaacatgttccagtttttggaagcacaagtggatccgttcgttctactagtcctaatgtccagccttctatctctcaacctattttaactgttcagcaacaaacacaggctacagcttttgtgcaacccactcaacagagtcatcctcagattgagcctgccaatcaagagttatcttcaaacatagtagaggttgttcagagttcaccagttgagcggccttctacttccacagcagtatttggcacagtttcggctacccccagttcttctttgccaaagcgtacacgtgaagaggaagaggatagcaccatagaagaaggtcggctcacggggggatactctag

SEQ ID NO: 369599 - DNA, 3538 bp, Homo sapiens
gcgcaagaggatcagggatagcctctgagctcgggttcccagggttcgtagcttccaacggctgcgcgcgcacttcggtcgcgggcggtgaggtgctgttgctgaaacgctgccgctgagggtggactcgatttcccagggtcccgccgcgggagtctccggcgggcgggcgcgcgcgagccaccgagcgaggtgatagaggcggcggcccaggcgtctgggtcctgctggtcttcgcctttcttctccgcttctaccccgtcggccgctgccactggggtccctggccccaccgacatggcggcggtgttgcagcaagtcctggagcgcacggagctgaacaagctgcccaagtctgtccagaacaaacttgaaaagttccttgctgatcagcaatccgagatcgatggcctgaaggggcggcatgagaaatttaaggtggagagcgaacaacagtattttgaaatagaaaagaggttgtcccacagtcaggagagacttgtgaatgaaacccgagagtgtcaaagcttgcggcttgagctagagaaactcaacaatcaactgaaggcactaactgagaaaaacaaagaacttgaaattgctcaggatcgcaatattgccattcagagccaatttacaagaacaaaggaagaattagaagctgagaaaagagacttaattagaaccaatgagagactatctcaagaacttgaatacttaacagaggatgttaaacgtctgaatgaaaaacttaaagaaagcaatacaacaaagggtgaacttcagttaaaattggatgaacttcaagcttctgatgtttctgttaagtatcgagaaaaacgcttggagcaagaaaaggaattgctacatagtcagaatacatggctgaatacagagttgaaaaccaaaactgatgaacttctggctcttggaagagaaaaagggaatgagattctagagcttaaatgtaatcttgaaaataaaaaagaagaggtttctagactggaagaacaaatgaatggcttaaaaacatcaaatgaacatcttcaaaagcatgtggaggatctgttgaccaaattaaaagaggccaaggaacaacaggccagtatggaagagaaattccacaatgaattaaatgcccacataaaactttctaatttgtacaagagtgccgctgatgactcagaagcaaagagcaatgaactaacccgggcagtagaggaactacacaaacttttgaaagaagctggtgaagccaacaaagcaatacaagatcatcttctagaggtggagcaatccaaagatcaaatggaaaaagaaatgcttgagaaaatagggagattggagaaggaattagagaatgcaaatgaccttctttctgccacaaaacgtaaaggagccatattgtctgaagaagagcttgccgccatgtctcctactgcagcagctgtagctaagatagtgaaacctgggatgaaactaactgagctctataatgcttatgtggaaactcaggatcagttgcttttggagaaactagagaacaaaagaattaataagtacctagatgaaatagtgaaagaagtggaagccaaagcaccaattttgaaacgccagcgtgaggaatatgaacgtgcacagaaagctgtagcaagtttatctgttaagcttgaacaagctatgaaggagattcagcgattgcaggaggacactgataaagccaacaagcaatcatctgtacttgagagagataatcgaagaatggaaatacaagtaaaagatctttcacaacagattagagtgcttttgatggaacttgaagaagcaaggggtaaccacgtaattcgtgatgaggaagtaagctctgctgatataagtagttcatctgaggtaatatcacagcatctagtatcttacagaaatattgaagagcttcaacaacaaaatcaacgtctcttagtggcccttagagagcttggggaaaccagagaaagagaagaacaagaaacaacttcatccaaaatcactgagcttcagctcaaacttgagagtgcccttactgaactagaacaactccgcaaatcacgacagcatcaaatgcagcttgttgattccatagttcgtcagcgtgatatgtaccgtattttattgtcacaaacaacaggagttgccattccattacatgcttcaagcttagatgatgtttctcttgcatcaactccaaaacgtccaagtacatcacagactgtttccactcctgctccagtacctgttattgaatcaacagaggctatagaggctaaggctgcccttaaacagttgcaggaaatttttgagaactacaaaaaagaaaaagcagaaaatgaaaaaatacaaaatgagcagcttgagaaacttcaagaacaagttacagatttgcgatcacaaaataccaaaatttctacccagctagattttgcttctaaacgttacttgtagaattacttttttcataccagttatgaaatgctgcaagataatgttgaaggatatcgtcgagaaataacatcacttcatgagagaaatcagaaactcactgccacaactcaaaagcaagaacagattatcaatacgatgactcaagatttgagaggagcaaatgagaagctagctgtcgcagaagtaagagcagaaaatttgaagaaggaaaaggaaatgcttaaattgtctgaagttcgtctttctcagcaaagagagtctttgttagctgaacaaagggggcaaaacttactgctaactaatctgcaaacaattcagggaatactggagcgatctgaaacagaaaccaaacaaaggcttagtagccagatagaaaaactggaacatgagatctctcatctaaagaagaagttggaaaatgaggtggaacaaaggcatacacttactagaaatctagatgttcaacttttagatacaaagagacaactggatacagagacaaatcttcatcttaacacaaaagaactattaaaaaatgctcaaaaagaaattgccacattgaaacagcacctcagtaatatggaagtccaagttgcttctcagtcttcacagagaactggtaaaggtcagcctagcaacaaagaagatgtggatgatcttgtgagtcagctaagacagacagaagagcaggtgaatgacttaaaggagagactcaaaacaagtacgagcaatgtggaacaatatcaagcaatggttactagtttagaagaatccctgaacaaggaaaaacaggtgacagaagaagtgcgtaagaatattgaagttcgtttaaaagagtcagctgaatttcagacacagttggaaaagaagttgatggaagtagagaaggaaaaacaagaacttcaggatgataaaagaagagccatagagagcatggaacaacagttatctttttttcacttagacgtcagtgggtcagatgcaacattgggtatccattttacctttcatgtacggccaaactagcacaagtgttacaattacttgtctctacaaaaat

SEQ ID NO: 369600 - DNA, 326 bp, Homo sapiens
aggagcctttgtcagtgaattttggctaaaattcaatatatgcggagagaattaacaataatgacaatttttttgtggcatttttagtggactcttgtgggctaggaacaacaatcaagagctttctctttataggtccctgaacagcagagacagatcacattgaaaacaactccagcttctggtgaaagaggaatgtgagttttagttatttcatagtctgttatttttcttttaaagctcagggaatatctagtgatctttctgtttaggaaaaagaaatctgtgtattctattgtaaaaacatacactaaagagttgttttc

SEQ ID NO: 369601 - DNA, 344 bp, Homo sapiens
ggaggttacatttgctctattaaccaaccaaaaaatagactcaaagaggttaagggacttgcccaaagccacacagcgaataagtacacatcccattgtctctgggtgtaaaacccacatttgcttccatcacacctcactactttacttctgaaaatattcgtacggtgaacattcctgttggcaagatttatacttctagggattgtccaagtttttttgtggtaaatttagcagttcaaaagtaaatttctcttttcctacaggtgaaggaaatacaggtgctgcagaatcttctttttctcaggaggtttctagagaacaacagccatcatcagcatctg

SEQ ID NO: 369602 - DNA, 566 bp, Homo sapiens
cacccgggctcaagtgatcctctagcctcagcctcctgagtaactgggactgtaggcatgttccaccatgcccagctaattgttttataattttgtagaaacagggtctcgctgtgttgcccaggctggtctcgaactcctgagctcaagtgatcctcccaccttagcctcccaaagtgctgctttttttgttgtttaaccatttaccctttttcggtttgttaaatgttcctcattgtttgaaaaaaagaattgaaatcaaatgaacaagtctacatcttattcattcattcatttagtaattagtttgtatcattataaatgctttctcattttttcacttgcttttcttttatcttaatgtttttcttagatactagtagtagtcaaccaaagcctttcagacgagtaagacttcagacaacattgagacaaggtgtccgtggtcgtcagtttaacagacagagaggtgaatttctgacataactggattacatgatagaatgtggaatagtaataaatggaacaagttttctaatccttaagcctccaatttatttttttaa

SEQ ID NO: 369603 - DNA, 1388 bp, Homo sapiens
gcccgcaaaaaaaatctatgtgttcctaacagtgctagatacttgggatatagtgatatagggaggaaagaattgagcaacaataccaaacaaaaaatttctactccaagacctcaggttatgggtaagacagatgtaataaatagataataaaataggcaagtagacaatttgcattcactgtgattagtgcctatctgtgggatcatagcggtagaggacttgtcctagatttcagggagcagaccggcttcatggagaacctggagaacctatgtaagaattagtcagaggttttttcaaaatacatgtataatgtcttctagaagaggaagaatggctaagaaagcaagaagactagagtttggagtgagtggaactgatttaatttttacaaacaaatttttcagattgcattggtaagtataagtacctgagtcctgtgtggtggggatttaaaaagtagttcataaaatactcagcatgaaaaaaaataatgagagagacaaaaatggtatgatgaatggtaggcaaagatgcttggttaattacagtagaaattacaatcagttaactctcagttcagtcctgtgaattaggccgactttttctacagaatcactgagcttcagctcaaacttgagagtgcccttactgaactagaacaactccgcaaatcacgacagcatcaaatgcagcttgttgattccatagttcgtcagcgtgatatgtaccgtattttattgtcacaaacaacaggagttgccattccattacatgcttcaagcttagatgatgtttctcttgcatcaactccaaaacgtccaagtacatcacagactgtttccactcctgctccagtacctgttattgaatcaacagaggctatagaggctaaggctgcccttaaacagttgcaggaaatttttgagaactacaaaaaagaaaaagcagaaaatgaaaaaatacaaaatgagcagcttgagaaacttcaagaacaagttacagatttgcgatcacaaaataccaaaatttctacccagctagattttgcttctaaacgttatgaaatgctgcaagataatgttgaaggatatcgtcgagaaataacatcacttcatgagagaaatcagaaactcactgccacaactcaaaagcaagaacagattatcaatacgatgactcaagatttgagaggagcaaatgagaagctagctgtcgcagaagtaagagcagaaaatttgaagaaggaaaaggaaatgcttaaattgtctgaagttcgtctttctcagcaaagagagtctttgttagctgaacaaagggggcaaaacttactgctaactaatctgcaaacaattcagggaaatgggaactgggtaccgagctgg

SEQ ID NO: 369604 - DNA, 8180 bp, Homo sapiens
gcgcaagaggatcagggatagcctctgagctcgggttcccagggttcgtagcttccaacggctgcgcgcgcacttcggtcgcgggcggtgaggtgctgttgctgaaacgctgccgctgagggtggactcgatttcccagggtcccgccgcgggagtctccggcgggcgggcgcgcgcgagccaccgagcgaggtgatagaggcggcggcccaggcgtctgggtcctgctggtcttcgcctttcttctccgcttctaccccgtcggccgctgccactggggtccctggccccaccgacatggcggcggtgttgcagcaagtcctggagcgcacggagctgaacaagctgcccaagtctgtccagaacaaacttgaaaagttccttgctgatcagcaatccgagatcgatggcctgaaggggcggcatgagaaatttaaggtggagagcgaacaacagtattttgaaatagaaaagaggttgtcccacagtcaggagagacttgtgaatgaaacccgagagtgtcaaagcttgcggcttgagctagagaaactcaacaatcaactgaaggcactaactgagaaaaacaaagaacttgaaattgctcaggatcgcaatattgccattcagagccaatttacaagaacaaaggaagaattagaagctgagaaaagagacttaattagaaccaatgagagactatctcaagaacttgaatacttaacagaggatgttaaacgtctgaatgaaaaacttaaagaaagcaatacaacaaagggtgaacttcagttaaaattggatgaacttcaagcttctgatgtttctgttaagtatcgagaaaaacgcttggagcaagaaaaggaattgctacatagtcagaatacatggctgaatacagagttgaaaaccaaaactgatgaacttctggctcttggaagagaaaaagggaatgagattctagagcttaaatgtaatcttgaaaataaaaaagaagaggtttctagactggaagaacaaatgaatggcttaaaaacatcaaatgaacatcttcaaaagcatgtggaggatctgttgaccaaattaaaagaggccaaggaacaacaggccagtatggaagagaaattccacaatgaattaaatgcccacataaaactttctaatttgtacaagagtgccgctgatgactcagaagcaaagagcaatgaactaacccgggcagtagaggaactacacaaacttttgaaagaagctggtgaagccaacaaagcaatacaagatcatcttctagaggtggagcaatccaaagatcaaatggaaaaagaaatgcttgagaaaatagggagattggagaaggaattagagaatgcaaatgaccttctttctgccacaaaacgtaaaggagccatattgtctgaagaagagcttgccgccatgtctcctactgcagcagctgtagctaagatagtgaaacctgggatgaaactaactgagctctataatgcttatgtggaaactcaggatcagttgcttttggagaaactagagaacaaaagaattaataagtacctagatgaaatagtgaaagaagtggaagccaaagcaccaattttgaaacgccagcgtgaggaatatgaacgtgcacagaaagctgtagcaagtttatctgttaagcttgaacaagctatgaaggagattcagcgattgcaggaggacactgataaagccaacaagcaatcatctgtacttgagagagataatcgaagaatggaaatacaagtaaaagatctttcacaacagattagagtgcttttgatggaacttgaagaagcaaggggtaaccacgtaattcgtgatgaggaagtaagctctgctgatataagtagttcatctgaggtaatatcacagcatctagtatcttacagaaatattgaagagcttcaacaacaaaatcaacgtctcttagtggcccttagagagcttggggaaaccagagaaagagaagaacaagaaacaacttcatccaaaatcactgagcttcagctcaaacttgagagtgcccttactgaactagaacaactccgcaaatcacgacagcatcaaatgcagcttgttgattccatagttcgtcagcgtgatatgtaccgtattttattgtcacaaacaacaggagttgccattccattacatgcttcaagcttagatgatgtttctcttgcatcaactccaaaacgtccaagtacatcacagactgtttccactcctgctccagtacctgttattgaatcaacagaggctatagaggctaaggctgcccttaaacagttgcaggaaatttttgagaactacaaaaaagaaaaagcagaaaatgaaaaaatacaaaatgagcagcttgagaaacttcaagaacaagttacagatttgcgatcacaaaataccaaaatttctacccagctagattttgcttctaaacgttatgaaatgctgcaagataatgttgaaggatatcgtcgagaaataacatcacttcatgagagaaatcagaaactcactgccacaactcaaaagcaagaacagattatcaatacgatgactcaagatttgagaggagcaaatgagaagctagctgtcgcagaagtaagagcagaaaatttgaagaaggaaaaggaaatgcttaaattgtctgaagttcgtctttctcagcaaagagagtctttgttagctgaacaaagggggcaaaacttactgctaactaatctgcaaacaattcagggaatactggagcgatctgaaacagaaaccaaacaaaggcttagtagccagatagaaaaactggaacatgagatctctcatctaaagaagaagttggaaaatgaggtggaacaaaggcatacacttactagaaatctagatgttcaacttttagatacaaagagacaactggatacagagacaaatcttcatcttaacacaaaagaactattaaaaaatgctcaaaaagaaattgccacattgaaacagcacctcagtaatatggaagtccaagttgcttctcagtcttcacagagaactggtaaaggtcagcctagcaacaaagaagatgtggatgatcttgtgagtcagctaagacagacagaagagcaggtgaatgacttaaaggagagactcaaaacaagtacgagcaatgtggaacaatatcaagcaatggttactagtttagaagaatccctgaacaaggaaaaacaggtgacagaagaagtgcgtaagaatattgaagttcgtttaaaagagtcagctgaatttcagacacagttggaaaagaagttgatggaagtagagaaggaaaaacaagaacttcaggatgataaaagaagagccatagagagcatggaacaacagttatctgaattgaagaaaacactttctagtgttcagaatgaagtacaagaagctcttcagagagcaagcacagctttaagtaatgagcagcaagccagacgtgactgtcaggaacaagctaaaatagctgtggaagctcagaataagtatgagagagaattgatgctgcatgctgctgatgttgaagctctacaagctgcgaaggagcaggtttcaaaaatggcatcagtccgtcagcatttggaagaaacaacacagaaagcagaatcacagttgttggagtgtaaagcatcttgggaggaaagagagagaatgttaaaggatgaagtttccaaatgtgtatgtcgctgtgaagatctggagaaacaaaacagattacttcatgatcagatcgaaaaattaagtgacaaggtcgttgcctctgtgaaggaaggtgtacaaggtccactgaatgtatctctcagtgaagaaggaaaatctcaagaacaaattttggaaattctcagatttatacgacgagaaaaagaaattgctgaaactaggtttgaggtggctcaggttgagagtctgcgttatcgacaaagggttgaacttttagaaagagagctgcaggaactgcaagatagtctaaatgctgaaagggagaaagtccaggtaactgcaaaaacaatggctcagcatgaagaactgatgaagaaaactgaaacaatgaatgtagttatggagaccaataaaatgctaagagaagagaaggagagactagaacaggatctacagcaaatgcaagcaaaggtgaggaaactggagttagatattttacccttacaagaagcaaatgctgagctgagtgagaaaagcggtatgttgcaggcagagaagaagctcttagaagaggatgtcaaacgttggaaagcacgtaaccagcatctagtaagtcaacagaaagatccagatacagaagaatatcggaagctcctttctgaaaaggaagttcatactaagcgtattcaacaattgacagaagaaattggtagacttaaagctgaaattgcaagatcaaatgcatctttgactaacaaccagaacttaattcagagtctgaaggaagatctaaataaagtaagaactgaaaaggaaaccatccagaaggacttagatgccaaaataattgatatccaagaaaaagtcaaaactattactcaagttaagaaaattggacgtaggtacaagactcaatatgaagaacttaaagcacaacaggataaggttatggagacatcggctcagtcctctggagaccatcaggagcagcatgtttcagtccaggaaatgcaggaactcaaagaaacgctcaaccaagctgaaacaaaatcaaaatcacttgaaagtcaagtagagaatctgcagaagacattatctgaaaaagagacagaagcaagaaatctccaggaacagactgtgcaacttcagtctgaactttcacgacttcgtcaggatcttcaagatagaaccacacaggaggagcagctccgacaacagataactgaaaaggaagaaaaaaccagaaaggctattgtagcagcaaagtcaaaaattgcacacttagctggtgtaaaagatcagctaactaaagaaaatgaggagcttaaacaaaggaatggagccttagatcagcagaaagatgaattggatgttcgcattactgcgctaaagtcccaatatgaaggtcgaattagtcgcttggaaagagaactcagggagcatcaagagagacaccttgagcagagagatgagcctcaagaaccttctaataaggtccctgaacagcagagacagatcacattgaaaacaactccagcttctggtgaaagaggaattgccagcacatcagacccaccaacagccaatatcaagccaactcctgttgtgtctactccaagtaaagtgacagctgcagctatggctggaaataagtcaacacccagggctagtatccgcccaatggttacacctgcaactgttacaaatcccactactaccccaacagctacagtgatgcccactacacaagtggaatcacaggaagctatgcagtcagaagggcctgtggaacatgttccagtttttggaagcacaagtggatccgttcgttctactagtcctaatgtccagccttctatctctcaacctattttaactgttcagcaacaaacacaggctacagcttttgtgcaacccactcaacagagtcatcctcagattgagcctgccaatcaagagttatcttcaaacatagtagaggttgttcagagttcaccagttgagcggccttctacttccacagcagtatttggcacagtttcggctacccccagttcttctttgccaaagcgtacacgtgaagaggaagaggatagcaccatagaagcatcagaccaagtctctgatgatacagtggaaatgcctcttccaaagaagttgaaaagtgtcacacctgtaggaactgaggaagaagttatggcagaagaaagtactgatggagaggtagagactcaggtatacaaccaggattctcaagattccattggagaaggagttacccagggagattatacacctatggaagacagtgaagaaacctctcagtctctacaaatagatcttgggccacttcaatcagatcagcagacgacaacttcatcccaggatggtcaaggcaaaggagatgatgtcattgtaattgacagtgatgatgattatgaagaggatgaggaagatgatgatgatgatgaagatgacacagggatgggagatgagggtgaagatagtaatgaaggaactggtagtgccgatggcaatgatggttatgaagctgatgatgctgagggtggtgatgggactgatccaggtacagaaacagaagaaagtatgggtggaggtgaaggtaatcacagagctgctgattctcaaaacagtggtgaaggaaatacaggtgctgcagaatcttctttttctcaggaggtttctagagaacaacagccatcatcagcatctgaaagacaggcccctcgagcacctcagtcaccgagacgcccaccacatccacttcccccaagactgaccattcatgccccacctcaggagttgggaccaccagttcagagaattcagatgacccgaaggcagtctgtaggacgtggccttcagttgactccaggaataggtggcatgcaacagcatttttttgatgatgaagacagaacagttccaagtactccaactcttgtggtgccacatcgtactgatggatttgctgaagcaattcattcgccgcaggttgctggtgtccctagattccggtttgggccacctgaagatatgccacaaacaagttctagtcactctgatcttggccagcttgcttctcaaggaggtttaggaatgtatgaaacacccctgttcctagctcatgaagaagagtcaggtggccgaagtgttcccactactccactacaagtagcagccccagtgactgtatttactgagagcaccacctctgatgcttcggaacatgcctctcaatctgttccaatggtgactacatccactggcactttatctacaacaaatgaaacagcaacaggtgatgatggagatgaagtatttgtggaggcagaatctgaaggtattagttcagaagcaggcctagaaattgatagccagcaggaagaagagccggttcaagcatctgatgagtcagatctcccctccaccagccaggatcctccttctagctcatctgtagatactagtagtagtcaaccaaagcctttcagacgagtaagacttcagacaacattgagacaaggtgtccgtggtcgtcagtttaacagacagagaggtgtgagccatgcaatgggagggagaggaggaataaacagaggaaatattaattaaatggtctgtaaacaataacaactgtgaataagattatcaaatctgttttagtgtaatgattgtcaagtttaaaaacatttttatatataaactggtatactcatgtcaatattctttattaataaaatgtttttcagtgtcaaaatttattattcatttcttcattagttgactcctcctttgctcatcagtctaaggacagttgtaccagactttggataaggtctgcccagaacgagtagtaattgctcttgctgttctactaggcacatcaatgttatagtattgatctttagaaaaggcatagtaatcatagccgtcaggttttctgatgttgggcagtgatatagctgaggtaaccacatttggaagtcctctccacagtatactcactttaacttcattatgaaggacacctgtaagtggcatgtttaataaaagataccagattaaaaggcaatgtactatcttggaaagagccagacatctgagttttaatctcagttttagccctctgatgtagaactattgagggttatagactggtatataatgttcttggtaagaagtacttgataaatagtattggttataactaacaaacctgaacaaactgctttacttacccacaaggaaaaagaaagtattggtctttggttattcactaaggcaagtggatgagtttttcatcagtaagcttaaattattagggctgtttgatcagtatccatatttcataagccttactgtataagaaactgtattacatctacttatgtttaaggatttttttaacacaataaaaatgttacctttgtcttgataaaaaa

SEQ ID NO: 369605 - DNA, 7514 bp, Homo sapiens
catagagagcgtggcggtatcccggagcctgccgtccggccctaccgggaccgatgccctctagtggctcagtgtccagaagccgccaacgaggacgatccatggcatcccggggctttgacgggtcccgccgcgggagtctccggcgggcgggcgcgcgcgagccaccgagcgaggtgatagaggcggcggcccaggcgtctgggtcctgctggtcttcgcctttcttctccgcttctaccccgtcggccgctgccactggggtccctggccccaccgacatggcggcggtgttgcagcaagtcctggagcgcacggagctgaacaagctgcccaagtctgtccagaacaaacttgaaaagttccttgctgatcagcaatccgagatcgatggcctgaaggggcggcatgagaaatttaaggtggagagcgaacaacagtattttgaaatagaaaagaggttgtcccacagtcaggagagacttgtgaatgaaacccgagagtgtcaaagcttgcggcttgagctagagaaactcaacaatcaactgaaggcactaactgagaaaaacaaagaacttgaaattgctcaggatcgcaatattgccattcagagccaatttacaagaacaaaggaagaattagaagctgagaaaagagacttaattagaaccaatgagagactatctcaagaacttgaatacttaacagaggatgttaaacgtctgaatgaaaaacttaaagaaagcaatacaacaaagggtgaacttcagttaaaattggatgaacttcaagcttctgatgtttctgttaagtatcgagaaaaacgcttggagcaagaaaaggaattgctacatagtcagaatacatggctgaatacagagttgaaaaccaaaactgatgaacttctggctcttggaagagaaaaagggaatgagattctagagcttaaatgtaatcttgaaaataaaaaagaagaggtttctagactggaagaacaaatgaatggcttaaaaacatcaaatgaacatcttcaaaagcatgtggaggatctgttgaccaaattaaaagaggccaaggaacaacaggccagtatggaagagaaattccacaatgaattaaatgcccacataaaactttctaatttgtacaagagtgccgctgatgactcagaagcaaagagcaatgaactaacccgggcagtagaggaactacacaaacttttgaaagaagctggtgaagccaacaaagcaatacaagatcatcttctagaggtggagcaatccaaagatcaaatggaaaaagaaatgcttgagaaaatagggagattggagaaggaattagagaatgcaaatgaccttctttctgccacaaaacgtaaaggagccatattgtctgaagaagagcttgccgccatgtctcctactgcagcagctgtagctaagatagtgaaacctgggatgaaactaactgagctctataatgcttatgtggaaactcaggatcagttgcttttggagaaactagagaacaaaagaattaataagtacctagatgaaatagtgaaagaagtggaagccaaagcaccaattttgaaacgccagcgtgaggaatatgaacgtgcacagaaagctgtagcaagtttatctgttaagcttgaacaagctatgaaggagattcagcgattgcaggaggacactgataaagccaacaagcaatcatctgtacttgagagagataatcgaagaatggaaatacaagtaaaagatctttcacaacagattagagtgcttttgatggaacttgaagaagcaaggggtaaccacgtaattcgtgatgaggaagtaagctctgctgatataagtagttcatctgaggtaatatcacagcatctagtatcttacagaaatattgaagagcttcaacaacaaaatcaacgtctcttagtggcccttagagagcttggggaaaccagagaaagagaagaacaagaaacaacttcatccaaaatcactgagcttcagctcaaacttgagagtgcccttactgaactagaacaactccgcaaatcacgacagcatcaaatgcagcttgttgattccatagttcgtcagcgtgatatgtaccgtattttattgtcacaaacaacaggagttgccattccattacatgcttcaagcttagatgatgtttctcttgcatcaactccaaaacgtccaagtacatcacagactgtttccactcctgctccagtacctgttattgaatcaacagaggctatagaggctaaggctgcccttaaacagttgcaggaaatttttgagaactacaaaaaagaaaaagcagaaaatgaaaaaatacaaaatgagcagcttgagaaacttcaagaacaagttacagatttgcgatcacaaaataccaaaatttctacccagctagattttgcttctaaacgttatgaaatgctgcaagataatgttgaaggatatcgtcgagaaataacatcacttcatgagagaaatcagaaactcactgccacaactcaaaagcaagaacagattatcaatacgatgactcaagatttgagaggagcaaatgagaagctagctgtcgcagaagtaagagcagaaaatttgaagaaggaaaaggaaatgcttaaattgtctgaagttcgtctttctcagcaaagagagtctttgttagctgaacaaagggggcaaaacttactgctaactaatctgcaaacaattcagggaatactggagcgatctgaaacagaaaccaaacaaaggcttagtagccagatagaaaaactggaacatgagatctctcatctaaagaagaagttggaaaatgaggtggaacaaaggcatacacttactagaaatctagatgttcaacttttagatacaaagagacaactggatacagagacaaatcttcatcttaacacaaaagaactattaaaaaatgctcaaaaagaaattgccacattgaaacagcacctcagtaatatggaagtccaagttgcttctcagtcttcacagagaactggtaaaggtcagcctagcaacaaagaagatgtggatgatcttgtgagtcagctaagacagacagaagagcaggtgaatgacttaaaggagagactcaaaacaagtacgagcaatgtggaacaatatcaagcaatggttactagtttagaagaatccctgaacaaggaaaaacaggtgacagaagaagtgcgtaagaatattgaagttcgtttaaaagagtcagctgaatttcagacacagttggaaaagaagttgatggaagtagagaaggaaaaacaagaacttcaggatgataaaagaagagccatagagagcatggaacaacagttatctgaattgaagaaaacactttctagtgttcagaatgaagtacaagaagctcttcagagagcaagcacagctttaagtaatgagcagcaagccagacgtgactgtcaggaacaagctaaaatagctgtggaagctcagaataagtatgagagagaattgatgctgcatgctgctgatgttgaagctctacaagctgcgaaggagcaggtttcaaaaatggcatcagtccgtcagcatttggaagaaacaacacagaaagcagaatcacagttgttggagtgtaaagcatcttgggaggaaagagagagaatgttaaaggatgaagtttccaaatgtgtatgtcgctgtgaagatctggagaaacaaaacagattacttcatgatcagatcgaaaaattaagtgacaaggtcgttgcctctgtgaaggaaggtgtacaaggtccactgaatgtatctctcagtgaagaaggaaaatctcaagaacaaattttggaaattctcagatttatacgacgagaaaaagaaattgctgaaactaggtttgaggtggctcaggttgagagtctgcgttatcgacaaagggttgaacttttagaaagagagctgcaggaactgcaagatagtctaaatgctgaaagggagaaagtccaggtaactgcaaaaacaatggctcagcatgaagaactgatgaagaaaactgaaacaatgaatgtagttatggagaccaataaaatgctaagagaagagaaggagagactagaacaggatctacagcaaatgcaagcaaaggtgaggaaactggagttagatattttacccttacaagaagcaaatgctgagctgagtgagaaaagcggtatgttgcaggcagagaagaagctcttagaagaggatgtcaaacgttggaaagcacgtaaccagcatctagtaagtcaacagaaagatccagatacagaagaatatcggaagctcctttctgaaaaggaagttcatactaagcgtattcaacaattgacagaagaaattggtagacttaaagctgaaattgcaagatcaaatgcatctttgactaacaaccagaacttaattcagagtctgaaggaagatctaaataaagtaagaactgaaaaggaaaccatccagaaggacttagatgccaaaataattgatatccaagaaaaagtcaaaactattactcaagttaagaaaattggacgtaggtacaagactcaatatgaagaacttaaagcacaacaggataaggttatggagacatcggctcagtcctctggagaccatcaggagcagcatgtttcagtccaggaaatgcaggaactcaaagaaacgctcaaccaagctgaaacaaaatcaaaatcacttgaaagtcaagtagagaatctgcagaagacattatctgaaaaagagacagaagcaagaaatctccaggaacagactgtgcaacttcagtctgaactttcacgacttcgtcaggatcttcaagatagaaccacacaggaggagcagctccgacaacagataactgaaaaggaagaaaaaaccagaaaggctattgtagcagcaaagtcaaaaattgcacacttagctggtgtaaaagatcagctaactaaagaaaatgaggagcttaaacaaaggaatggagccttagatcagcagaaagatgaattggatgttcgcattactgcgctaaagtcccaatatgaaggtcgaattagtcgcttggaaagagaactcagggagcatcaagagagacaccttgagcagagagatgagcctcaagaaccttctaataaggtccctgaacagcagagacagatcacattgaaaacaactccagcttctggtgaaagaggaattgccagcacatcagacccaccaacagccaatatcaagccaactcctgttgtgtctactccaagtaaagtgacagctgcagctatggctggaaataagtcaacacccagggctagtatccgcccaatggttacacctgcaactgttacaaatcccactactaccccaacagctacagtgatgcccactacacaagtggaatcacaggaagctatgcagtcagaagggcctgtggaacatgttccagtttttggaagcacaagtggatccgttcgttctactagtcctaatgtccagccttctatctctcaacctattttaactgttcagcaacaaacacaggctacagcttttgtgcaacccactcaacagagtcatcctcagattgagcctgccaatcaagagttatcttcaaacatagtagaggttgttcagagttcaccagttgagcggccttctacttccacagcagtatttggcacagtttcggctacccccagttcttctttgccaaagcgtacacgtgaagaggaagaggatagcaccatagaagcatcagaccaagtctctgatgatacagtggaaatgcctcttccaaagaagttgaaaagtgtcacacctgtaggaactgaggaagaagttatggcagaagaaagtactgatggagaggtagagactcaggtatacaaccaggattctcaagattccattggagaaggagttacccagggagattatacacctatggaagacagtgaagaaacctctcagtctctacaaatagatcttgggccacttcaatcagatcagcagacgacaacttcatcccaggatggtcaaggcaaaggagatgatgtcattgtaattgacagtgatgatgaagaagaggatgatgatgaaaatgatggagaacatgaggattatgaagaggatgaggaagatgatgatgatgatgaagatgacacagggatgggagatgagggtgaagatagtaatgaaggaactggtagtgccgatggcaatgatggttatgaagctgatgatgctgagggtggtgatgggactgatccaggtacagaaacagaagaaagtatgggtggaggtgaaggtaatcacagagctgctgattctcaaaacagtggtgaaggaaatacaggtgctgcagaatcttctttttctcaggaggtttctagagaacaacagccatcatcagcatctgaaagacaggcccctcgagcacctcagtcaccgagacgcccaccacatccacttcccccaagactgaccattcatgccccacctcaggagttgggaccaccagttcagagaattcagatgacccgaaggcagtctgtaggacgtggccttcagttgactccaggaataggtggcatgcaacagcatttttttgatgatgaagacagaacagttccaagtactccaactcttgtggtgccacatcgtactgatggatttgctgaagcaattcattcgccgcaggttgctggtgtccctagattccggtttgggccacctgaagatatgccacaaacaagttctagtcactctgatcttggccagcttgcttctcaaggaggtttaggaatgtatgaaacacccctgttcctagctcatgaagaagagtcaggtggccgaagtgttcccactactccactacaagtagcagccccagtgactgtatttactgagagcaccacctctgatgcttcggaacatgcctctcaatctgttccaatggtgactacatccactggcactttatctacaacaaatgaaacagcaacaggtgatgatggagatgaagtatttgtggaggcagaatctgaaggtattagttcagaagcaggcctagaaattgatagccagcaggaagaagagccggttcaagcatctgatgagtcagatctcccctccaccagccaggatcctccttctagctcatctgtagatactagtagtagtcaaccaaagcctttcagacgagtaagacttcagacaacattgagacaaggtgtccgtggtcgtcagtttaacagacagagaggtgtgagccatgcaatgggagggagaggaggaataaacagaggaaatattaattaaatggtctgtaaacaataacaactgtgaataagattatcaaatctgttttagtgtaatgattgtcaagtttaaaaacatttttatatataaactggtatactcatgtcaatattctttattaataaaatgtttttcagtgtc

SEQ ID NO: 369606 - DNA, 8547 bp, Homo sapiens
  misc_feature (4006)..(4006): n is a, c, g, or t
  misc_feature (4051)..(4051): n is a, c, g, or t
  misc_feature (4424)..(4424): n is a, c, g, or t
  misc_feature (4450)..(4450): n is a, c, g, or t
gcccgcaaaaaaaatctatgtgttcctaacagtgctagatacttgggatatagtgatatagggaggaaagaattgagcaacaataccaaacaaaaaatttctactccaagacctcaggttatgggtaagacagatgtaataaatagataataaaataggcaagtagacaatttgcattcactgtgattagtgcctatctgtgggatcatagcggtagaggacttgtcctagatttcagggagcagaccggcttcatggagaacctggagaacctatgtaagaattagtcagaggttttttcaaaatacatgtataatgtcttctagaagaggaagaatggctaagaaagcaagaagactagagtttggagtgagtggaactgatttaatttttacaaacaaatttttcagattgcattggtaagtataagtacctgagtcctgtgtggtggggatttaaaaagtagttcataaaatactcagcatgaaaaaaaataatgagagagacaaaaatggtatgatgaatggtaggcaaagatgcttggttaattacagtagaaattacaatcagttaactctcagttcagtcctgtgaattaggccgactttttctacagaatcactgagcttcagctcaaacttgagagtgcccttactgaactagaacaactccgcaaatcacgacagcatcaaatgcagcttgttgattccatagttcgtcagcgtgatatgtaccgtattttattgtcacaaacaacaggagttgccattccattacatgcttcaagcttagatgatgtttctcttgcatcaactccaaaacgtccaagtacatcacagactgtttccactcctgctccagtacctgttattgaatcaacagaggctatagaggctaaggctgcccttaaacagttgcaggaaatttttgagaactacaaaaaagaaaaagcagaaaatgaaaaaatacaaaatgagcagcttgagaaacttcaagaacaagttacagatttgcgatcacaaaataccaaaatttctacccagctagattttgcttctaaacgttatgaaatgctgcaagataatgttgaaggatatcgtcgagaaataacatcacttcatgagagaaatcagaaactcactgccacaactcaaaagcaagaacagattatcaatacgatgactcaagatttgagaggagcaaatgagaagctagctgtcgcagaagtaagagcagaaaatttgaagaaggaaaaggaaatgcttaaattgtctgaagttcgtctttctcagcaaagagagtctttgttagctgaacaaagggggcaaaacttactgctaactaatctgcaaacaattcagggaatactggagcgatctgaaacagaaaccaaacaaaggcttagtagccagatagaaaaactggaacatgagatctctcatctaaagaagaagttggaaaatgaggtggaacaaaggcatacacttactagaaatctagatgttcaacttttagatacaaagagacaactggatacagagacaaatcttcatcttaacacaaaagaactattaaaaaatgctcaaaaagaaattgccacattgaaacagcacctcagtaatatggaagtccaagttgcttctcagtcttcacagagaactggtaaaggtcagcctagcaacaaagaagatgtggatgatcttgtgagtcagctaagacagacagaagagcaggtgaatgacttaaaggagagactcaaaacaagtacgagcaatgtggaacaatatcaagcaatggttactagtttagaagaatccctgaacaaggaaaaacaggtgacagaagaagtgcgtaagaatattgaagttcgtttaaaagagtcagctgaatttcagacacagttggaaaagaagttgatggaagtagagaaggaaaaacaagaacttcaggatgataaaagaagagccatagagagcatggaacaacagttatctgaattgaagaaaacactttctagtgttcagaatgaagtacaagaagctcttcagagagcaagcacagctttaagtaatgagcagcaagccagacgtgactgtcaggaacaagctaaaatagctgtggaagctcagaataagtatgagagagaattgatgctgcatgctgctgatgttgaagctctacaagctgcgaaggagcaggtttcaaaaatggcatcagtccgtcagcatttggaagaaacaacacagaaagcagaatcacagttgttggagtgtaaagcatcttgggaggaaagagagagaatgttaaaggatgaagtttccaaatgtgtatgtcgctgtgaagatctggagaaacaaaacagattacttcatgatcagatcgaaaaattaagtgacaaggtcgttgcctctgtgaaggaaggtgtacaaggtccactgaatgtatctctcagtgaagaaggaaaatctcaagaacaaattttggaaattctcagatttatacgacgagaaaaagaaattgctgaaactaggtttgaggtggctcaggttgagagtctgcgttatcgacaaagggttgaacttttagaaagagagctgcaggaactgcaagatagtctaaatgctgaaagggagaaagtccaggtaggtatactaagctttaagaaagcacttgttaaatcaaaagagaagcactcatttatatctctaccatttaacgtaatgtaaaatttaacttgaagtaagcattcttctaaacttgtaaattcattaagcatttgttaaacactaatatagtatagtgcttaaaagtaaaggctctgtaaccaaactgcctggtttcagattctagcttcataccattagctgtggccttgggtacattgtttaacttccctgctcttagtttcttcatctgtaatatttggataataatgaggtttaattgagtttgtgcacatgaagcatttagaagcatgtctggtatgtagtgggtgcttaataaattccagctatcttaatttattatagttatggattatacgtgtggatagtcattctaggataaagtgatttaaactgctacagaatatctttctcacccaaggagcaaaaagtagtaaaaactaacaaccaaaggaaaagaagctgtggtagtgaaatggatgataataagacaagcttgactccttaccccacactaccacccaaagcttattgttgagttacttcattcttaggagctacagtaatatacccccacctctagaaggaaggaaattaagatcttaaaacatttatcttcttttaactgatgagtagtcaaaatgactgttaagaagaaaccattgaacagggaaaagtaaataatgaattttatgggatttatgtgttcagcaaaagctaaaggttccagaattatatcctgtttaattcaaatgtatctcaccatggaaataatagagcctccagttcaatagagttaatacttggaggaaaagggacagaatcagagtctctaacaaagactgcatattgtttcagtcttttccgcttcattttttattcctttgggctatagaaagtaaatactagaaaatgcccgcctacgaatgagttcatagggggaaaccaactcttaaatacaggaagaagagagtcaacaagtaacatagattatataaaaaataatataatgggccgggcatggtggctcatgcctgtaatcccagcactttgggaggccgaggcgggtggatcacgaggttaggagattgagaccatcctggctaacacggtgaaaccccgtctctactaaaaatacaaaaaaattagctgggcatggtggtggcaggcacctgtagtcccagctactcgggaggctgaggcaggagaacggcgtaaatccgggaggcggagcttgcagtgagccgagatcacaccactggactccagtctgggcgacagagcgagactccgtctcaaaaaaaaaaaaaaattataatagnaatgtaatgtctgtctaagcatgaacagtgtagcatggcaaccangaaatatgctatagctttaaaaacagtgggggaagaaagtaataccaagtgcagaagatggataattataacctatgagaaggaaaaaattcttcacagataattcagtaaaatttctcatggccaaagtgatgaaacaatggatcaaaatgagagatttctgaacaagagggaataaactgaggattagaataacattttagaactaataaatttagtgcagcaaggaaaaaaagatacagaaaggtaaatagagatttggattaatgtttttacctaatgttaatactttgttggtgggatttgtagcatcttttcacttttgtctttgtaattcttgtatttgtttaaagtctgcagttcgcatgcctcncagaaaagtaaacgtgaactttcaanaattttagttctaaaagttgaaacttaaatcctctttattttgtcatagggaggatttgagctcataggaacaggtagactttcaactattgttagatgttggtatgtatatttatttgaaatgtttaggtaactgcaaaaacaatggctcagcatgaagaactgatgaagaaaactgaaacaatgaatgtagttatggagaccaataaaatgctaagagaagagaaggagagactagaacaggatctacagcaaatgcaagcaaaggtgaggaaactggagttagatattttacccttacaagaagcaaatgctgagctgagtgagaaaagcggtatgttgcaggcagagaagaagctcttagaagaggatgtcaaacgttggaaagcacgtaaccagcatctagtaagtcaacagaaagatccagatacagaagaatatcggaagctcctttctgaaaaggaagttcatactaagcgtattcaacaattgacagaagaaattggtagacttaaagctgaaattgcaagatcaaatgcatctttgactaacaaccagaacttaattcagagtctgaaggaagatctaaataaagtaagaactgaaaaggaaaccatccagaaggacttagatgccaaaataattgatatccaagaaaaagtcaaaactattactcaagttaagaaaattggacgtaggtacaagactcaatatgaagaacttaaagcacaacaggataaggttatggagacatcggctcagtcctctggagaccatcaggagcagcatgtttcagtccaggaaatgcaggaactcaaagaaacgctcaaccaagctgaaacaaaatcaaaatcacttgaaagtcaagtagagaatctgcagaagacattatctgaaaaagagacagaagcaagaaatctccaggaacagactgtgcaacttcagtctgaactttcacgacttcgtcaggatcttcaagatagaaccacacaggaggagcagctccgacaacagataactgaaaaggaagaaaaaaccagaaaggctattgtagcagcaaagtcaaaaattgcacacttagctggtgtaaaagatcagctaactaaagaaaatgaggagcttaaacaaaggaatggagccttagatcagcagaaagatgaattggatgttcgcattactgcgctaaagtcccaatatgaaggtcgaattagtcgcttggaaagagaactcagggagcatcaagagagacaccttgagcagagagatgagcctcaagaaccttctaataaggtccctgaacagcagagacagatcacattgaaaacaactccagcttctggtgaaagaggaattgccagcacatcagacccaccaacagccaatatcaagccaactcctgttgtgtctactccaagtaaagtgacagctgcagctatggctggaaataagtcaacacccagggctagtatccgcccaatggttacacctgcaactgttacaaatcccactactaccccaacagctacagtgatgcccactacacaagtggaatcacaggaagctatgcagtcagaagggcctgtggaacatgttccagtttttggaagcacaagtggatccgttcgttctactagtcctaatgtccagccttctatctctcaacctattttaactgttcagcaacaaacacaggctacagcttttgtgcaacccactcaacagagtcatcctcagattgagcctgccaatcaagagttatcttcaaacatagtagaggttgttcagagttcaccagttgagcggccttctacttccacagcagtatttggcacagtttcggctacccccagttcttctttgccaaagcgtacacgtgaagaggaagaggatagcaccatagaagcatcagaccaagtctctgatgatacagtggaaatgcctcttccaaagaagttgaaaagtgtcacacctgtaggaactgaggaagaagttatggcagaagaaagtactgatggagaggtagagactcaggtatacaaccaggattctcaagattccattggagaaggagttacccagggagattatacacctatggaagacagtgaagaaacctctcagtctctacaaatagatcttgggccacttcaatcagatcagcagacgacaacttcatcccaggatggtcaaggcaaaggagatgatgtcattgtaattgacagtgatgatgaagaagaggatgatgatgaaaatgatggagaacatgaggattatgaagaggatgaggaagatgatgatgatgatgaagatgacacagggatgggagatgagggtgaagatagtaatgaaggaactggtagtgccgatggcaatgatggttatgaagctgatgatgctgagggtggtgatgggactgatccaggtacagaaacagaagaaagtatgggtggaggtgaaggtaatcacagagctgctgattctcaaaacagtggtgaaggaaatacaggtgctgcagaatcttctttttctcaggaggtttctagagaacaacagccatcatcagcatctgaaagacaggcccctcgagcacctcagtcaccgagacgcccaccacatccacttcccccaagactgaccattcatgccccacctcaggagttgggaccaccagttcagagaattcagatgacccgaaggcagtctgtaggacgtggccttcagttgactccaggaataggtggcatgcaacagcatttttttgatgatgaagacagaacagttccaagtactccaactcttgtggtgccacatcgtactgatggatttgctgaagcaattcattcgccgcaggttgctggtgtccctagattccggtttgggccacctgaagatatgccacaaacaagttctagtcactctgatcttggccagcttgcttctcaaggaggtttaggaatgtatgaaacacccctgttcctagctcatgaagaagagtcaggtggccgaagtgttcccactactccactacaagtagcagccccagtgactgtatttactgagagcaccacctctgatgcttcggaacatgcctctcaatctgttccaatggtgactacatccactggcactttatctacaacaaatgaaacagcaacaggtgatgatggagatgaagtatttgtggaggcagaatctgaaggtattagttcagaagcaggcctagaaattgatagccagcaggaagaagagccggttcaagcatctgatgagtcagatctcccctccaccagccaggatcctccttctagctcatctgtagatactagtagtagtcaaccaaagcctttcagacgagtaagacttcagacaacattgagacaaggtgtccgtggtcgtcagtttaacagacagagaggtgtgagccatgcaatgggagggagaggaggaataaacagaggaaatattaattaaatggtctgtaaacaataacaactgtgaataagattatcaaatctgttttagtgtaatgattgtcaagtttaaaaacatttttatatataaactggtatactcatgtcaatattctttattaataaaatgtttttcagtgtcaaaatttattattcatttcttcattagttgactcctcctttgctcatcagtctaaggacagttgtaccagactttggataaggtctgcccagaacgagtagtaattgctcttgctgttctactaggcacatcaatgttatagtattgatctaaatggaagagaaaacatttttttagttaaaaagaaaacaatgcccaaactaaaaaataacttatgttgactattatgctcaaagacaatgtttatcattttaatagagatgtttttactaattaatttgaactttataacaaaaagaaaaacaattgcctagacttttcagcttttttgatgtttcaaaagattgacatttcaccatctttttgtaaaatcaggttcagctctcctttatgaagtaaacattaaagagtaaccaagtttgaaaaataatttacttggggttattccttttaaaaaatacatgccaatgtcattcatattatga

SEQ ID NO: 369607 - DNA, 9263 bp, Homo sapiens
  misc_feature (5441)..(5441): n is a, c, g, or t
  misc_feature (5486)..(5486): n is a, c, g, or t
  misc_feature (5859)..(5859): n is a, c, g, or t
  misc_feature (5885)..(5885): n is a, c, g, or t
gcgcaagaggatcagggatagcctctgagctcgggttcccagggttcgtagcttccaacggctgcgcgcgcacttcggtcgcgggcggtgaggtgctgttgctgaaacgctgccgctgagggtggactcgatttcccagggtcccgccgcgggagtctccggcgggcgggcgcgcgcgagccaccgagcgaggtgatagaggcggcggcccaggcgtctgggtcctgctggtcttcgcctttcttctccgcttctaccccgtcggccgctgccactggggtccctggccccaccgacatggcggcggtgttgcagcaagtcctggagcgcacggagctgaacaagctgcccaagtctgtccagaacaaacttgaaaagttccttgctgatcagcaatccgagatcgatggcctgaaggggcggcatgagaaatttaaggtggagagcgaacaacagtattttgaaatagaaaagaggttgtcccacagtcaggagagacttgtgaatgaaacccgagagtgtcaaagcttgcggcttgagctagagaaactcaacaatcaactgaaggcactaactgagaaaaacaaagaacttgaaattgctcaggatcgcaatattgccattcagagccaatttacaagaacaaaggaagaattagaagctgagaaaagagacttaattagaaccaatgagagactatctcaagaacttgaatacttaacagaggatgttaaacgtctgaatgaaaaacttaaagaaagcaatacaacaaagggtgaacttcagttaaaattggatgaacttcaagcttctgatgtttctgttaagtatcgagaaaaacgcttggagcaagaaaaggaattgctacatagtcagaatacatggctgaatacagagttgaaaaccaaaactgatgaacttctggctcttggaagagaaaaagggaatgagattctagagcttaaatgtaatcttgaaaataaaaaagaagaggtttctagactggaagaacaaatgaatggcttaaaaacatcaaatgaacatcttcaaaagcatgtggaggatctgttgaccaaattaaaagaggccaaggaacaacaggccagtatggaagagaaattccacaatgaattaaatgcccacataaaactttctaatttgtacaagagtgccgctgatgactcagaagcaaagagcaatgaactaacccgggcagtagaggaactacacaaacttttgaaagaagctggtgaagccaacaaagcaatacaagatcatcttctagaggtggagcaatccaaagatcaaatggaaaaagaaatgcttgagaaaatagggagattggagaaggaattagagaatgcaaatgaccttctttctgccacaaaacgtaaaggagccatattgtctgaagaagagcttgccgccatgtctcctactgcagcagctgtagctaagatagtgaaacctgggatgaaactaactgagctctataatgcttatgtggaaactcaggatcagttgcttttggagaaactagagaacaaaagaattaataagtacctagatgaaatagtgaaagaagtggaagccaaagcaccaattttgaaacgccagcgtgaggaatatgaacgtgcacagaaagctgtagcaagtttatctgttaagcttgaacaagctatgaaggagattcagcgattgcaggaggacactgataaagccaacaagcaatcatctgtacttgagagagataatcgaagaatggaaatacaagtaaaagatctttcacaacagattagagtgcttttgatggaacttgaagaagcaaggggtaaccacgtaattcgtgatgaggaagtaagctctgctgatataagtagttcatctgaggtaatatcacagcatctagtatcttacagaaatattgaagagcttcaacaacaaaatcaacgtctcttagtggcccttagagagcttggggaaaccagagaaagagaagaacaagaaacaacttcatccaaaatcactgagcttcagctcaaacttgagagtgcccttactgaactagaacaactccgcaaatcacgacagcatcaaatgcagcttgttgattccatagttcgtcagcgtgatatgtaccgtattttattgtcacaaacaacaggagttgccattccattacatgcttcaagcttagatgatgtttctcttgcatcaactccaaaacgtccaagtacatcacagactgtttccactcctgctccagtacctgttattgaatcaacagaggctatagaggctaaggctgcccttaaacagttgcaggaaatttttgagaactacaaaaaagaaaaagcagaaaatgaaaaaatacaaaatgagcagcttgagaaacttcaagaacaagttacagatttgcgatcacaaaataccaaaatttctacccagctagattttgcttctaaacgttacttgtagaattacttttttcataccagttatgaaatgctgcaagataatgttgaaggatatcgtcgagaaataacatcacttcatgagagaaatcagaaactcactgccacaactcaaaagcaagaacagattatcaatacgatgactcaagatttgagaggagcaaatgagaagctagctgtcgcagaagtaagagcagaaaatttgaagaaggaaaaggaaatgcttaaattgtctgaagttcgtctttctcagcaaagagagtctttgttagctgaacaaagggggcaaaacttactgctaactaatctgcaaacaattcagggaatactggagcgatctgaaacagaaaccaaacaaaggcttagtagccagatagaaaaactggaacatgagatctctcatctaaagaagaagttggaaaatgaggtggaacaaaggcatacacttactagaaatctagatgttcaacttttagatacaaagagacaactggatacagagacaaatcttcatcttaacacaaaagaactattaaaaaatgctcaaaaagaaattgccacattgaaacagcacctcagtaatatggaagtccaagttgcttctcagtcttcacagagaactggtaaaggtcagcctagcaacaaagaagatgtggatgatcttgtgagtcagctaagacagacagaagagcaggtgaatgacttaaaggagagactcaaaacaagtacgagcaatgtggaacaatatcaagcaatggttactagtttagaagaatccctgaacaaggaaaaacaggtgacagaagaagtgcgtaagaatattgaagttcgtttaaaagagtcagctgaatttcagacacagttggaaaagaagttgatggaagtagagaaggaaaaacaagaacttcaggatgataaaagaagagccatagagagcatggaacaacagttatctgaattgaagaaaacactttctagtgttcagaatgaagtacaagaagctcttcagagagcaagcacagctttaagtaatgagcagcaagccagacgtgactgtcaggaacaagctaaaatagctgtggaagctcagaataagtatgagagagaattgatgctgcatgctgctgatgttgaagctctacaagctgcgaaggagcaggtttcaaaaatggcatcagtccgtcagcatttggaagaaacaacacagaaagcagaatcacagttgttggagtgtaaagcatcttgggaggaaagagagagaatgttaaaggatgaagtttccaaatgtgtatgtcgctgtgaagatctggagaaacaaaacagattacttcatgatcagatcgaaaaattaagtgacaaggtcgttgcctctgtgaaggaaggtgtacaaggtccactgaatgtatctctcagtgaagaaggaaaatctcaagaacaaattttggaaattctcagatttatacgacgagaaaaagaaattgctgaaactaggtttgaggtggctcaggttgagagtctgcgttatcgacaaagggttgaacttttagaaagagagctgcaggaactgcaagatagtctaaatgctgaaagggagaaagtccaggtaggtatactaagctttaagaaagcacttgttaaatcaaaagagaagcactcatttatatctctaccatttaacgtaatgtaaaatttaacttgaagtaagcattcttctaaacttgtaaattcattaagcatttgttaaacactaatatagtatagtgcttaaaagtaaaggctctgtaaccaaactgcctggtttcagattctagcttcataccattagctgtggccttgggtacattgtttaacttccctgctcttagtttcttcatctgtaatatttggataataatgaggtttaattgagtttgtgcacatgaagcatttagaagcatgtctggtatgtagtgggtgcttaataaattccagctatcttaatttattatagttatggattatacgtgtggatagtcattctaggataaagtgatttaaactgctacagaatatctttctcacccaaggagcaaaaagtagtaaaaactaacaaccaaaggaaaagaagctgtggtagtgaaatggatgataataagacaagcttgactccttaccccacactaccacccaaagcttattgttgagttacttcattcttaggagctacagtaatatacccccacctctagaaggaaggaaattaagatcttaaaacatttatcttcttttaactgatgagtagtcaaaatgactgttaagaagaaaccattgaacagggaaaagtaaataatgaattttatgggatttatgtgttcagcaaaagctaaaggttccagaattatatcctgtttaattcaaatgtatctcaccatggaaataatagagcctccagttcaatagagttaatacttggaggaaaagggacagaatcagagtctctaacaaagactgcatattgtttcagtcttttccgcttcattttttattcctttgggctatagaaagtaaatactagaaaatgcccgcctacgaatgagttcatagggggaaaccaactcttaaatacaggaagaagagagtcaacaagtaacatagattatataaaaaataatataatgggccgggcatggtggctcatgcctgtaatcccagcactttgggaggccgaggcgggtggatcacgaggttaggagattgagaccatcctggctaacacggtgaaaccccgtctctactaaaaatacaaaaaaattagctgggcatggtggtggcaggcacctgtagtcccagctactcgggaggctgaggcaggagaacggcgtaaatccgggaggcggagcttgcagtgagccgagatcacaccactggactccagtctgggcgacagagcgagactccgtctcaaaaaaaaaaaaaaattataatagnaatgtaatgtctgtctaagcatgaacagtgtagcatggcaaccangaaatatgctatagctttaaaaacagtgggggaagaaagtaataccaagtgcagaagatggataattataacctatgagaaggaaaaaattcttcacagataattcagtaaaatttctcatggccaaagtgatgaaacaatggatcaaaatgagagatttctgaacaagagggaataaactgaggattagaataacattttagaactaataaatttagtgcagcaaggaaaaaaagatacagaaaggtaaatagagatttggattaatgtttttacctaatgttaatactttgttggtgggatttgtagcatcttttcacttttgtctttgtaattcttgtatttgtttaaagtctgcagttcgcatgcctcncagaaaagtaaacgtgaactttcaanaattttagttctaaaagttgaaacttaaatcctctttattttgtcatagggaggatttgagctcataggaacaggtagactttcaactattgttagatgttggtatgtatatttatttgaaatgtttaggtaactgcaaaaacaatggctcagcatgaagaactgatgaagaaaactgaaacaatgaatgtagttatggagaccaataaaatgctaagagaagagaaggagagactagaacaggatctacagcaaatgcaagcaaaggtgaggaaactggagttagatattttacccttacaagaagcaaatgctgagctgagtgagaaaagcggtatgttgcaggcagagaagaagctcttagaagaggatgtcaaacgttggaaagcacgtaaccagcatctagtaagtcaacagaaagatccagatacagaagaatatcggaagctcctttctgaaaaggaagttcatactaagcgtattcaacaattgacagaagaaattggtagacttaaagctgaaattgcaagatcaaatgcatctttgactaacaaccagaacttaattcagagtctgaaggaagatctaaataaagtaagaactgaaaaggaaaccatccagaaggacttagatgccaaaataattgatatccaagaaaaagtcaaaactattactcaagttaagaaaattggacgtaggtacaagactcaatatgaagaacttaaagcacaacaggataaggttatggagacatcggctcagtcctctggagaccatcaggagcagcatgtttcagtccaggaaatgcaggaactcaaagaaacgctcaaccaagctgaaacaaaatcaaaatcacttgaaagtcaagtagagaatctgcagaagacattatctgaaaaagagacagaagcaagaaatctccaggaacagactgtgcaacttcagtctgaactttcacgacttcgtcaggatcttcaagatagaaccacacaggaggagcagctccgacaacagataactgaaaaggaagaaaaaaccagaaaggctattgtagcagcaaagtcaaaaattgcacacttagctggtgtaaaagatcagctaactaaagaaaatgaggagcttaaacaaaggaatggagccttagatcagcagaaagatgaattggatgttcgcattactgcgctaaagtcccaatatgaaggtcgaattagtcgcttggaaagagaactcagggagcatcaagagagacaccttgagcagagagatgagcctcaagaaccttctaataaggtccctgaacagcagagacagatcacattgaaaacaactccagcttctggtgaaagaggaattgccagcacatcagacccaccaacagccaatatcaagccaactcctgttgtgtctactccaagtaaagtgacagctgcagctatggctggaaataagtcaacacccagggctagtatccgcccaatggttacacctgcaactgttacaaatcccactactaccccaacagctacagtgatgcccactacacaagtggaatcacaggaagctatgcagtcagaagggcctgtggaacatgttccagtttttggaagcacaagtggatccgttcgttctactagtcctaatgtccagccttctatctctcaacctattttaactgttcagcaacaaacacaggctacagcttttgtgcaacccactcaacagagtcatcctcagattgagcctgccaatcaagagttatcttcaaacatagtagaggttgttcagagttcaccagttgagcggccttctacttccacagcagtatttggcacagtttcggctacccccagttcttctttgccaaagcgtacacgtgaagaggaagaggatagcaccatagaagcatcagaccaagtctctgatgatacagtggaaatgcctcttccaaagaagttgaaaagtgtcacacctgtaggaactgaggaagaagttatggcagaagaaagtactgatggagaggtagagactcaggtatacaaccaggattctcaagattccattggagaaggagttacccagggagattatacacctatggaagacagtgaagaaacctctcagtctctacaaatagatcttgggccacttcaatcagatcagcagacgacaacttcatcccaggatggtcaaggcaaaggagatgatgtcattgtaattgacagtgatgatgaagaagaggatgatgatgaaaatgatggagaacatgaggattatgaagaggatgaggaagatgatgatgatgatgaagatgacacagggatgggagatgagggtgaagatagtaatgaaggaactggtagtgccgatggcaatgatggttatgaagctgatgatgctgagggtggtgatgggactgatccaggtacagaaacagaagaaagtatgggtggaggtgaaggtaatcacagagctgctgattctcaaaacagtggtgaaggaaatacaggtgctgcagaatcttctttttctcaggaggtttctagagaacaacagccatcatcagcatctgaaagacaggcccctcgagcacctcagtcaccgagacgcccaccacatccacttcccccaagactgaccattcatgccccacctcaggagttgggaccaccagttcagagaattcagatgacccgaaggcagtctgtaggacgtggccttcagttgactccaggaataggtggcatgcaacagcatttttttgatgatgaagacagaacagttccaagtactccaactcttgtggtgccacatcgtactgatggatttgctgaagcaattcattcgccgcaggttgctggtgtccctagattccggtttgggccacctgaagatatgccacaaacaagttctagtcactctgatcttggccagcttgcttctcaaggaggtaaatagttaaacctttagatcccctgaatttgtatgtatttggtaataaactattaagatgtgatttaaggggggaaaaagagcaaatatgaatatttttaaaattgatattgtttgctaatttatttttttaaatgctgtagtatacttattaagcactgccttacatcttatctttccaacaaagttctaatttctttgagcataaggattagcttttacattagtatctcttctggctcctggtgtaatgtcatacacgtagtttaagtattcaggaatatgtgttgaaccaataaatataggtactactagccattttaaagttgttggaaggaatgcagcatgttttctgtttacagcttgacacttgtaacatttctaattaaatgtataaggctagttatattttttgtattaacattactt

SEQ ID NO: 369608 - DNA, 7249 bp, Homo sapiens
  misc_feature (5441)..(5441): n is a, c, g, or t
  misc_feature (5486)..(5486): n is a, c, g, or t
  misc_feature (5859)..(5859): n is a, c, g, or t
  misc_feature (5885)..(5885): n is a, c, g, or t
gcgcaagaggatcagggatagcctctgagctcgggttcccagggttcgtagcttccaacggctgcgcgcgcacttcggtcgcgggcggtgaggtgctgttgctgaaacgctgccgctgagggtggactcgatttcccagggtcccgccgcgggagtctccggcgggcgggcgcgcgcgagccaccgagcgaggtgatagaggcggcggcccaggcgtctgggtcctgctggtcttcgcctttcttctccgcttctaccccgtcggccgctgccactggggtccctggccccaccgacatggcggcggtgttgcagcaagtcctggagcgcacggagctgaacaagctgcccaagtctgtccagaacaaacttgaaaagttccttgctgatcagcaatccgagatcgatggcctgaaggggcggcatgagaaatttaaggtggagagcgaacaacagtattttgaaatagaaaagaggttgtcccacagtcaggagagacttgtgaatgaaacccgagagtgtcaaagcttgcggcttgagctagagaaactcaacaatcaactgaaggcactaactgagaaaaacaaagaacttgaaattgctcaggatcgcaatattgccattcagagccaatttacaagaacaaaggaagaattagaagctgagaaaagagacttaattagaaccaatgagagactatctcaagaacttgaatacttaacagaggatgttaaacgtctgaatgaaaaacttaaagaaagcaatacaacaaagggtgaacttcagttaaaattggatgaacttcaagcttctgatgtttctgttaagtatcgagaaaaacgcttggagcaagaaaaggaattgctacatagtcagaatacatggctgaatacagagttgaaaaccaaaactgatgaacttctggctcttggaagagaaaaagggaatgagattctagagcttaaatgtaatcttgaaaataaaaaagaagaggtttctagactggaagaacaaatgaatggcttaaaaacatcaaatgaacatcttcaaaagcatgtggaggatctgttgaccaaattaaaagaggccaaggaacaacaggccagtatggaagagaaattccacaatgaattaaatgcccacataaaactttctaatttgtacaagagtgccgctgatgactcagaagcaaagagcaatgaactaacccgggcagtagaggaactacacaaacttttgaaagaagctggtgaagccaacaaagcaatacaagatcatcttctagaggtggagcaatccaaagatcaaatggaaaaagaaatgcttgagaaaatagggagattggagaaggaattagagaatgcaaatgaccttctttctgccacaaaacgtaaaggagccatattgtctgaagaagagcttgccgccatgtctcctactgcagcagctgtagctaagatagtgaaacctgggatgaaactaactgagctctataatgcttatgtggaaactcaggatcagttgcttttggagaaactagagaacaaaagaattaataagtacctagatgaaatagtgaaagaagtggaagccaaagcaccaattttgaaacgccagcgtgaggaatatgaacgtgcacagaaagctgtagcaagtttatctgttaagcttgaacaagctatgaaggagattcagcgattgcaggaggacactgataaagccaacaagcaatcatctgtacttgagagagataatcgaagaatggaaatacaagtaaaagatctttcacaacagattagagtgcttttgatggaacttgaagaagcaaggggtaaccacgtaattcgtgatgaggaagtaagctctgctgatataagtagttcatctgaggtaatatcacagcatctagtatcttacagaaatattgaagagcttcaacaacaaaatcaacgtctcttagtggcccttagagagcttggggaaaccagagaaagagaagaacaagaaacaacttcatccaaaatcactgagcttcagctcaaacttgagagtgcccttactgaactagaacaactccgcaaatcacgacagcatcaaatgcagcttgttgattccatagttcgtcagcgtgatatgtaccgtattttattgtcacaaacaacaggagttgccattccattacatgcttcaagcttagatgatgtttctcttgcatcaactccaaaacgtccaagtacatcacagactgtttccactcctgctccagtacctgttattgaatcaacagaggctatagaggctaaggctgcccttaaacagttgcaggaaatttttgagaactacaaaaaagaaaaagcagaaaatgaaaaaatacaaaatgagcagcttgagaaacttcaagaacaagttacagatttgcgatcacaaaataccaaaatttctacccagctagattttgcttctaaacgttacttgtagaattacttttttcataccagttatgaaatgctgcaagataatgttgaaggatatcgtcgagaaataacatcacttcatgagagaaatcagaaactcactgccacaactcaaaagcaagaacagattatcaatacgatgactcaagatttgagaggagcaaatgagaagctagctgtcgcagaagtaagagcagaaaatttgaagaaggaaaaggaaatgcttaaattgtctgaagttcgtctttctcagcaaagagagtctttgttagctgaacaaagggggcaaaacttactgctaactaatctgcaaacaattcagggaatactggagcgatctgaaacagaaaccaaacaaaggcttagtagccagatagaaaaactggaacatgagatctctcatctaaagaagaagttggaaaatgaggtggaacaaaggcatacacttactagaaatctagatgttcaacttttagatacaaagagacaactggatacagagacaaatcttcatcttaacacaaaagaactattaaaaaatgctcaaaaagaaattgccacattgaaacagcacctcagtaatatggaagtccaagttgcttctcagtcttcacagagaactggtaaaggtcagcctagcaacaaagaagatgtggatgatcttgtgagtcagctaagacagacagaagagcaggtgaatgacttaaaggagagactcaaaacaagtacgagcaatgtggaacaatatcaagcaatggttactagtttagaagaatccctgaacaaggaaaaacaggtgacagaagaagtgcgtaagaatattgaagttcgtttaaaagagtcagctgaatttcagacacagttggaaaagaagttgatggaagtagagaaggaaaaacaagaacttcaggatgataaaagaagagccatagagagcatggaacaacagttatctgaattgaagaaaacactttctagtgttcagaatgaagtacaagaagctcttcagagagcaagcacagctttaagtaatgagcagcaagccagacgtgactgtcaggaacaagctaaaatagctgtggaagctcagaataagtatgagagagaattgatgctgcatgctgctgatgttgaagctctacaagctgcgaaggagcaggtttcaaaaatggcatcagtccgtcagcatttggaagaaacaacacagaaagcagaatcacagttgttggagtgtaaagcatcttgggaggaaagagagagaatgttaaaggatgaagtttccaaatgtgtatgtcgctgtgaagatctggagaaacaaaacagattacttcatgatcagatcgaaaaattaagtgacaaggtcgttgcctctgtgaaggaaggtgtacaaggtccactgaatgtatctctcagtgaagaaggaaaatctcaagaacaaattttggaaattctcagatttatacgacgagaaaaagaaattgctgaaactaggtttgaggtggctcaggttgagagtctgcgttatcgacaaagggttgaacttttagaaagagagctgcaggaactgcaagatagtctaaatgctgaaagggagaaagtccaggtaggtatactaagctttaagaaagcacttgttaaatcaaaagagaagcactcatttatatctctaccatttaacgtaatgtaaaatttaacttgaagtaagcattcttctaaacttgtaaattcattaagcatttgttaaacactaatatagtatagtgcttaaaagtaaaggctctgtaaccaaactgcctggtttcagattctagcttcataccattagctgtggccttgggtacattgtttaacttccctgctcttagtttcttcatctgtaatatttggataataatgaggtttaattgagtttgtgcacatgaagcatttagaagcatgtctggtatgtagtgggtgcttaataaattccagctatcttaatttattatagttatggattatacgtgtggatagtcattctaggataaagtgatttaaactgctacagaatatctttctcacccaaggagcaaaaagtagtaaaaactaacaaccaaaggaaaagaagctgtggtagtgaaatggatgataataagacaagcttgactccttaccccacactaccacccaaagcttattgttgagttacttcattcttaggagctacagtaatatacccccacctctagaaggaaggaaattaagatcttaaaacatttatcttcttttaactgatgagtagtcaaaatgactgttaagaagaaaccattgaacagggaaaagtaaataatgaattttatgggatttatgtgttcagcaaaagctaaaggttccagaattatatcctgtttaattcaaatgtatctcaccatggaaataatagagcctccagttcaatagagttaatacttggaggaaaagggacagaatcagagtctctaacaaagactgcatattgtttcagtcttttccgcttcattttttattcctttgggctatagaaagtaaatactagaaaatgcccgcctacgaatgagttcatagggggaaaccaactcttaaatacaggaagaagagagtcaacaagtaacatagattatataaaaaataatataatgggccgggcatggtggctcatgcctgtaatcccagcactttgggaggccgaggcgggtggatcacgaggttaggagattgagaccatcctggctaacacggtgaaaccccgtctctactaaaaatacaaaaaaattagctgggcatggtggtggcaggcacctgtagtcccagctactcgggaggctgaggcaggagaacggcgtaaatccgggaggcggagcttgcagtgagccgagatcacaccactggactccagtctgggcgacagagcgagactccgtctcaaaaaaaaaaaaaaattataatagnaatgtaatgtctgtctaagcatgaacagtgtagcatggcaaccangaaatatgctatagctttaaaaacagtgggggaagaaagtaataccaagtgcagaagatggataattataacctatgagaaggaaaaaattcttcacagataattcagtaaaatttctcatggccaaagtgatgaaacaatggatcaaaatgagagatttctgaacaagagggaataaactgaggattagaataacattttagaactaataaatttagtgcagcaaggaaaaaaagatacagaaaggtaaatagagatttggattaatgtttttacctaatgttaatactttgttggtgggatttgtagcatcttttcacttttgtctttgtaattcttgtatttgtttaaagtctgcagttcgcatgcctcncagaaaagtaaacgtgaactttcaanaattttagttctaaaagttgaaacttaaatcctctttattttgtcatagggaggatttgagctcataggaacaggtagactttcaactattgttagatgttggtatgtatatttatttgaaatgtttaggtaactgcaaaaacaatggctcagcatgaagaactgatgaagaaaactgaaacaatgaatgtagttatggagaccaataaaatgctaagagaagagaaggagagactagaacaggatctacagcaaatgcaagcaaaggtgaggaaactggagttagatattttacccttacaagaagcaaatgctgagctgagtgagaaaagcggtatgttgcaggcagagaagaagctcttagaagaggatgtcaaacgttggaaagcacgtaaccagcatctagtaagtcaacagaaagatccagatacagaagaatatcggaagctcctttctgaaaaggaagttcatactaagcgtattcaacaattgacagaagaaattggtagacttaaagctgaaattgcaagatcaaatgcatctttgactaacaaccagaacttaattcagagtctgaaggaagatctaaataaagtaagaactgaaaaggaaaccatccagaaggacttagatgccaaaataattgatatccaagaaaaagtcaaaactattactcaagttaagaaaattggacgtaggtacaagactcaatatgaagaacttaaagcacaacaggataaggttatggagacatcggctcagtcctctggagaccatcaggagcagcatgtttcagtccaggaaatgcaggaactcaaagaaacgctcaaccaagctgaaacaaaatcaaaatcacttgaaagtcaagtagagaatctgcagaagacattatctgaaaaagagacagaagcaagaaatctccaggaacagactgtgcaacttcagtctgaactttcacgacttcgtcaggatcttcaagatagaaccacacaggaggatcacttgagtccaggagtttgaggctgcagtgaagcatgatcatgcaccacactctaagtgggacgacagggtaagaccctgttgcccgcaaaaaaaatctatgtgttcctaacagtgctagatacttgggatatagtgatatagggaggaaagaattgagcaacaataccaaacaaaaaatttctactccaagacctcaggttatgggtaagacagatgtataaatagataataaaataggcaagtagacaatttgcattcactgtgattagtgctatctgtgggatcatagcggtagaggacttgtcctagatttcagggagcagaccggttcatggagaacctggagaacctatgtaagaatt

SEQ ID NO: 369609 - DNA, 6183 bp, Homo sapiens
  misc_feature (1642)..(1642): n is a, c, g, or t
  misc_feature (1687)..(1687): n is a, c, g, or t
  misc_feature (2060)..(2060): n is a, c, g, or t
  misc_feature (2086)..(2086): n is a, c, g, or t
tagcaggacctcgagttctcccatcaggtgacaaggtcgttgcctctgtgaaggaaggtgtacaaggtccactgaatgtatctctcagtgaagaaggaaaatctcaagaacaaattttggaaattctcagatttatacgacgagaaaaagaaattgctgaaactaggtttgaggtggctcaggttgagagtctgcgttatcgacaaagggttgaacttttagaaagagagctgcaggaactgcaagatagtctaaatgctgaaagggagaaagtccaggtaggtatactaagctttaagaaagcacttgttaaatcaaaagagaagcactcatttatatctctaccatttaacgtaatgtaaaatttaacttgaagtaagcattcttctaaacttgtaaattcattaagcatttgttaaacactaatatagtatagtgcttaaaagtaaaggctctgtaaccaaactgcctggtttcagattctagcttcataccattagctgtggccttgggtacattgtttaacttccctgctcttagtttcttcatctgtaatatttggataataatgaggtttaattgagtttgtgcacatgaagcatttagaagcatgtctggtatgtagtgggtgcttaataaattccagctatcttaatttattatagttatggattatacgtgtggatagtcattctaggataaagtgatttaaactgctacagaatatctttctcacccaaggagcaaaaagtagtaaaaactaacaaccaaaggaaaagaagctgtggtagtgaaatggatgataataagacaagcttgactccttaccccacactaccacccaaagcttattgttgagttacttcattcttaggagctacagtaatatacccccacctctagaaggaaggaaattaagatcttaaaacatttatcttcttttaactgatgagtagtcaaaatgactgttaagaagaaaccattgaacagggaaaagtaaataatgaattttatgggatttatgtgttcagcaaaagctaaaggttccagaattatatcctgtttaattcaaatgtatctcaccatggaaataatagagcctccagttcaatagagttaatacttggaggaaaagggacagaatcagagtctctaacaaagactgcatattgtttcagtcttttccgcttcattttttattcctttgggctatagaaagtaaatactagaaaatgcccgcctacgaatgagttcatagggggaaaccaactcttaaatacaggaagaagagagtcaacaagtaacatagattatataaaaaataatataatgggccgggcatggtggctcatgcctgtaatcccagcactttgggaggccgaggcgggtggatcacgaggttaggagattgagaccatcctggctaacacggtgaaaccccgtctctactaaaaatacaaaaaaattagctgggcatggtggtggcaggcacctgtagtcccagctactcgggaggctgaggcaggagaacggcgtaaatccgggaggcggagcttgcagtgagccgagatcacaccactggactccagtctgggcgacagagcgagactccgtctcaaaaaaaaaaaaaaattataatagnaatgtaatgtctgtctaagcatgaacagtgtagcatggcaaccangaaatatgctatagctttaaaaacagtgggggaagaaagtaataccaagtgcagaagatggataattataacctatgagaaggaaaaaattcttcacagataattcagtaaaatttctcatggccaaagtgatgaaacaatggatcaaaatgagagatttctgaacaagagggaataaactgaggattagaataacattttagaactaataaatttagtgcagcaaggaaaaaaagatacagaaaggtaaatagagatttggattaatgtttttacctaatgttaatactttgttggtgggatttgtagcatcttttcacttttgtctttgtaattcttgtatttgtttaaagtctgcagttcgcatgcctcncagaaaagtaaacgtgaactttcaanaattttagttctaaaagttgaaacttaaatcctctttattttgtcatagggaggatttgagctcataggaacaggtagactttcaactattgttagatgttggtatgtatatttatttgaaatgtttaggtaactgcaaaaacaatggctcagcatgaagaactgatgaagaaaactgaaacaatgaatgtagttatggagaccaataaaatgctaagagaagagaaggagagactagaacaggatctacagcaaatgcaagcaaaggtgaggaaactggagttagatattttacccttacaagaagcaaatgctgagctgagtgagaaaagcggtatgttgcaggcagagaagaagctcttagaagaggatgtcaaacgttggaaagcacgtaaccagcatctagtaagtcaacagaaagatccagatacagaagaatatcggaagctcctttctgaaaaggaagttcatactaagcgtattcaacaattgacagaagaaattggtagacttaaagctgaaattgcaagatcaaatgcatctttgactaacaaccagaacttaattcagagtctgaaggaagatctaaataaagtaagaactgaaaaggaaaccatccagaaggacttagatgccaaaataattgatatccaagaaaaagtcaaaactattactcaagttaagaaaattggacgtaggtacaagactcaatatgaagaacttaaagcacaacaggataaggttatggagacatcggctcagtcctctggagaccatcaggagcagcatgtttcagtccaggaaatgcaggaactcaaagaaacgctcaaccaagctgaaacaaaatcaaaatcacttgaaagtcaagtagagaatctgcagaagacattatctgaaaaagagacagaagcaagaaatctccaggaacagactgtgcaacttcagtctgaactttcacgacttcgtcaggatcttcaagatagaaccacacaggaggagcagctccgacaacagataactgaaaaggaagaaaaaaccagaaaggctattgtagcagcaaagtcaaaaattgcacacttagctggtgtaaaagatcagctaactaaagaaaatgaggagcttaaacaaaggaatggagccttagatcagcagaaagatgaattggatgttcgcattactgcgctaaagtcccaatatgaaggtcgaattagtcgcttggaaagagaactcagggagcatcaagagagacaccttgagcagagagatgagcctcaagaaccttctaataaggtccctgaacagcagagacagatcacattgaaaacaactccagcttctggtgaaagaggaattgccagcacatcagacccaccaacagccaatatcaagccaactcctgttgtgtctactccaagtaaagtgacagctgcagctatggctggaaataagtcaacacccagggctagtatccgcccaatggttacacctgcaactgttacaaatcccactactaccccaacagctacagtgatgcccactacacaagtggaatcacaggaagctatgcagtcagaagggcctgtggaacatgttccagtttttggaagcacaagtggatccgttcgttctactagtcctaatgtccagccttctatctctcaacctattttaactgttcagcaacaaacacaggctacagcttttgtgcaacccactcaacagagtcatcctcagattgagcctgccaatcaagagttatcttcaaacatagtagaggttgttcagagttcaccagttgagcggccttctacttccacagcagtatttggcacagtttcggctacccccagttcttctttgccaaagcgtacacgtgaagaggaagaggatagcaccatagaagcatcagaccaagtctctgatgatacagtggaaatgcctcttccaaagaagttgaaaagtgtcacacctgtaggaactgaggaagaagttatggcagaagaaagtactgatggagaggtagagactcaggtatacaaccaggattctcaagattccattggagaaggagttacccagggagattatacacctatggaagacagtgaagaaacctctcagtctctacaaatagatcttgggccacttcaatcagatcagcagacgacaacttcatcccaggatggtcaaggcaaaggagatgatgtcattgtaattgacagtgatgatgaagaagaggatgatgatgaaaatgatggagaacatgaggattatgaagaggatgaggaagatgatgatgatgatgaagatgacacagggatgggagatgagggtgaagatagtaatgaaggaactggtagtgccgatggcaatgatggttatgaagctgatgatgctgagggtggtgatgggactgatccaggtacagaaacagaagaaagtatgggtggaggtgaaggtaatcacagagctgctgattctcaaaacagtggtgaaggaaatacaggtgctgcagaatcttctttttctcaggaggtttctagagaacaacagccatcatcagcatctgaaagacaggcccctcgagcacctcagtcaccgagacgcccaccacatccacttcccccaagactgaccattcatgccccacctcaggagttgggaccaccagttcagagaattcagatgacccgaaggcagtctgtaggacgtggccttcagttgactccaggaataggtggcatgcaacagcatttttttgatgatgaagacagaacagttccaagtactccaactcttgtggtgccacatcgtactgatggatttgctgaagcaattcattcgccgcaggttgctggtgtccctagattccggtttgggccacctgaagatatgccacaaacaagttctagtcactctgatcttggccagcttgcttctcaaggaggtttaggaatgtatgaaacacccctgttcctagctcatgaagaagagtcaggtggccgaagtgttcccactactccactacaagtagcagccccagtgactgtatttactgagagcaccacctctgatgcttcggaacatgcctctcaatctgttccaatggtgactacatccactggcactttatctacaacaaatgaaacagcaacaggtgatgatggagatgaagtatttgtggaggcagaatctgaaggtattagttcagaagcaggcctagaaattgatagccagcaggaagaagagccggttcaagcatctgatgagtcagatctcccctccaccagccaggatcctccttctagctcatctgtagatactagtagtagtcaaccaaagcctttcagacgagtaagacttcagacaacattgagacaaggtgtccgtggtcgtcagtttaacagacagagaggtgtgagccatgcaatgggagggagaggaggaataaacagaggaaatattaattaaatggtctgtaaacaataacaactgtgaataagattatcaaatctgttttagtgtaatgattgtcaagtttaaaaacatttttatatataaactggtatactcatgtcaatattctttattaataaaatgtttttcagtgtcaaaatttattattcatttcttcattagttgactcctcctttgctcatcagtctaaggacagttgtaccagactttggataaggtctgcccagaacgagtagtaattgctcttgctgttctactaggcacatcaatgttatagtattgatctaaatggaagagaaaacatttttttagttaaaaagaaaacaatgcccaaactaaaaaataacttatgttgactattatgctcaaagacaatgtttatcattttaatagagatgtttttactaattaatttgaactttataacaaaaagaaaaacaattgcctagacttttcagcttttttgatgtttcaaaagattgacatttcaccatctttttgtaaaatcaggttcagctctcctttatgaagtaaacattaaagagtaaccaagtttgaaaaataatttacttggggttattccttttaaaaaatacatgccaatgtcattcatattatga

SEQ ID NO: 369610 - DNA, 1533 bp, Homo sapiens
tgtctgctgactatttgttggcagcgtaataagctgtatctgttgatatttggtgtttgtttcattgcctcatttcttaaagcaaatgtaattcctttatcttgacacgcagagaattcagatgacccgaaggcagtctgtaggacgtggccttcagttgactccaggaataggtggcatgcaacagcatttttttgatgatgaagacagaacagttccaagtactccaactcttgtggtgccacatcgtactgatggatttgctgaagcaattcattcgccgcaggttgctggtgtccctagattccggtttgggccacctgaagatatgccacaaacaagttctagtcactctgatcttggccagcttgcttctcaaggaggtttaggaatgtatgaaacacccctgttcctagctcatgaagaagagtcaggtggccgaagtgttcccactactccactacaagtagcagccccagtgactgtatttactgagagcaccacctctgatgcttcggaacatgcctctcaatctgttccaatggtgactacatccactggcactttatctacaacaaatgaaacagcaacaggtgatgatggagatgaagtatttgtggaggcagaatctgaaggtattagttcagaagcaggcctagaaattgatagccagcaggaagaagagccggttcaagcatctgatgagtcagatctcccctccaccagccaggatcctccttctagctcatctgtagatactagtagtagtcaaccaaagcctttcagacgagtaagacttcagacaacattgagacaaggtgtccgtggtcgtcagtttaacagacagagaggtgtgagccatgcaatgggagggagaggaggaataaacagaggaaatattaattaaatggtctgtaaacaataacaactgtgaataagattatcaaatctgttttagtgtaatgattgtcaagtttaaaaacatttttatatataaactggtatactcatgtcaatattctttattaataaaatgtttttcagtgtcaaaatttattattcatttcttcattagttgactcctcctttgctcatcagtctaaggacagttgtaccagactttggataaggtctgcccagaacgagtagtaattgctcttgctgttctactaggcacatcaatgttatagtattgatctaaatggaagagaaaacatttttttagttaaaaagaaaacaatgcccaaactaaaaaataacttatgttgactattatgctcaaagacaatgtttatcattttaatagagatgtttttactaattaatttgaactttataacaaaaagaaaaacaattgcctagacttttcagcttttttgatgtttcaaaagattgacatttcaccatctttttgtaaaatcaggttcagctctcctttatgaagtaaacattaaagagtaaccaagtttgaaaaataatttacttggggttattccttttaaaaaatacatgccaatgtcattcatattatga

SEQ ID NO: 369611 - DNA, 2793 bp, Homo sapiens
gcgcaagaggatcagggatagcctctgagctcgggttcccagggttcgtagcttccaacggctgcgcgcgcacttcggtcgcgggcggtgaggtgctgttgctgaaacgctgccgctgagggtggactcgatttcccagggtcccgccgcgggagtctccggcgggcgggcgcgcgcgagccaccgagcgaggtgatagaggcggcggcccaggcgtctgggtcctgctggtcttcgcctttcttctccgcttctaccccgtcggccgctgccactggggtccctggccccaccgacatggcggcggtgttgcagcaagtcctggagcgcacggagctgaacaagctgcccaagtctgtccagaacaaacttgaaaagttccttgctgatcagcaatccgagatcgatggcctgaaggggcggcatgagaaatttaaggtggagagcgaacaacagtattttgaaatagaaaagaggttgtcccacagtcaggagagacttgtgaatgaaacccgagagtgtcaaagcttgcggcttgagctagagaaactcaacaatcaactgaaggcactaactgagaaaaacaaagaacttgaaattgctcaggatcgcaatattgccattcagagccaatttacaagaacaaaggaagaattagaagctgagaaaagagacttaattagaaccaatgagagactatctcaagaacttgaatacttaacagaggatgttaaacgtctgaatgaaaaacttaaagaaagcaatacaacaaagggtgaacttcagttaaaattggatgaacttcaagcttctgatgtttctgttaagtatcgagaaaaacgcttggagcaagaaaaggaattgctacatagtcagaatacatggctgaatacagagttgaaaaccaaaactgatgaacttctggctcttggaagagaaaaagggaatgagattctagagcttaaatgtaatcttgaaaataaaaaagaagaggtttctagactggaagaacaaatgaatggcttaaaaacatcaaatgaacatcttcaaaagcatgtggaggatctgttgaccaaattaaaagaggccaaggaacaacaggccagtatggaagagaaattccacaatgaattaaatgcccacataaaactttctaatttgtacaagagtgccgctgatgactcagaagcaaagagcaatgaactaacccgggcagtagaggaactacacaaacttttgaaagaagctggtgaagccaacaaagcaatacaagatcatcttctagaggtggagcaatccaaagatcaaatggaaaaagaaatgcttgagaaaatagggagattggagaaggaattagagaatgcaaatgaccttctttctgccacaaaacgtaaaggagccatattgtctgaagaagagcttgccgccatgtctcctactgcagcagctgtagctaagatagtgaaacctgggatgaaactaactgagctctataatgcttatgtggaaactcaggatcagttgcttttggagaaactagagaacaaaagaattaataagtacctagatgaaatagtgaaagaagtggaagccaaagcaccaattttgaaacgccagcgtgaggaatatgaacgtgcacagaaagctgtagcaagtttatctgttaagcttgaacaagctatgaaggagattcagcgattgcaggaggacactgataaagccaacaagcaatcatctgtacttgagagagataatcgaagaatggaaatacaagtaaaagatctttcacaacagattagagtgcttttgatggaacttgaagaagcaaggggtaaccacgtaattcgtgatgaggaagtaagctctgctgatataagtagttcatctgaggtaatatcacagcatctagtatcttacagaaatattgaagagcttcaacaacaaaatcaacgtctcttagtggcccttagagagcttggggaaaccagagaaagagaagaacaagaaacaacttcatccaaaatcactgagcttcagctcaaacttgagagtgcccttactgaactagaacaactccgcaaatcacgacagcatcaaatgcagcttgttgattccatagttcgtcagcgtgatatgtaccgtattttattgtcacaaacaacaggagttgccattccattacatgcttcaagcttagatgatgtttctcttgcatcaactccaaaacgtccaagtacatcacagactgtttccactcctgctccagtacctgttattgaatcaacagaggctatagaggctaaggctgcccttaaacagttgcaggaaatttttgagaactacaaaaaagaaaaagcagaaaatgaaaaaatacaaaatgagcagcttgagaaacttcaagaacaagttacagatttgcgatcacaaaataccaaaatttctacccagctagattttgcttctaaacgttatgaaatgctgcaagataatgttgaaggatatcgtcgagaaataacatcacttcatgagagaaatcagaaactcactgccacaactcaaaagcaagaacagattatcaatacgatgactcaagatttgagaggagcaaatgagaagctagctgtcgcagaagtaagagcagaaaatttgaagaaggaaaaggaaatgcttaaattgtctgaagttcgtctttctcagcaaagagagtctttgttagctgaacaaagggggcaaaacttactgctaactaatctgcaaacaattcagggaaatgggaactgggtaccgagctgg

SEQ ID NO: 369612 - DNA, 533 bp, Homo sapiens
tgccacacaacttgtggttctgacaccaaattgatagttttgtttcacatcaaattggacacattgtgcattcattaagatgtgcccagtgcttttcaagggggccaggaaatcaccttttaattcttaatcaaaaatcatagtaagatgtttattttcttaatcttcaaaagccactgatttgactgactcgtccttctaacaaatctttcctgtgcactgttgtgggccagctgtcactctagggctgggcattcaatagtcgtgtggtccctgctgtccctgagtgttgttcgtgttgggagggggtagtcagtgtacgtacacggatacacaaacatgatggtttcaggttgcgataagtatcatggagaaaagaagactgggccacggggatggaggagctggctctttagatggtgggtgtggagctggccccagcatggactcctgggaacagcggaggagccccagggcaaccctgttgctctgccttatggtcctggtgggggaggtgggagtacactgggggc

SEQ ID NO: 369613 - DNA, 905 bp, Homo sapiens
gggtaggcgaacgcgaactgctgggctgcaggcgggcccttcaggacccggcagcgcgagagggcagccctggagggacccagctgcagggccaggcgccatgacctttcgtagtgggggcggggacgcgctgggaaaggccgcctgtcttgtgccagccgcctcacgcccccagtctcccattttgcagatgacctcgcgagaggtcacgccgcaagtcggcaaccgggcaggatttggaatccgcgtctgcctttttcccccaagagacccagaatcctggcagccggtttcaaagctgttgtacgtacaccatacctcggggttcagatttataggtgtttttttgaaattgaggcttgtttccgttcagttgttactcgttaggcatctgtcatataccaggcactgtccttggtgctggagacacagcaatgaggaagatagataaaaatctctcatctcctgggggaaccagactttgaacaaattagaaataaacgaaacaggtgatttcagatactgataagttactaaaaatgcgttaatggtgtcgggaatttcgcttgaactcctgggctcaagcgatcctccccacttggacttccaaagcactaggattataggcatgagccactgctccctggctatttatttatttttagagacaggatctcagtatgttgcccaggctagagtgcagtggctattcacaagtgcagtcatggttcactgcaacctctaactactgaccttaaaggatcctccagcctcagtctcctgagtacctgagatgacaggcattcaccaccatgcctggataattcttaatttttttgtagagatggggtctctctatgttgcccaggctggtcttgaatccctgggctcaagtgatcctccta

SEQ ID NO: 369614 - DNA, 2780 bp, Homo sapiens
gatttgctacctccctggagctccctgacccggacgctctctgggccaatatggcagcgcccagcaacaagacagagctggcctggagtccgcggctggccgcgtgagtaggtgattgtctgacaagcagaggcatgagctgggtccaggccaccctactggcccgaggcctctgtagggcctggggaggcacctgcggggccgccctcacaggaacctccatctctcaggtccctcgccggctccctcggggcctccactgcagcgcagctgcccatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggttcctttgcccaaagactcaacaggtgcagcagatcccccccagccccacatcgtaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggtgagggcttaaagcaaagcatgtgttggggctggggagtgggctggcactaccctgagggtgcatgggagaggctggaggagggagaccgagagagccctggcctctgaccccgcctgcactccccaccttggagtaggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgcaaaaaaaaaaaaaaaaaaataaaaaaaaacaaaaaaaaaaaaacaaaaaaaaaaacaaaaaagaacaaaacaacaaaaaagaagagagagagacaacacaacaacaaaagaaaacacacataaagaaagaccaacacaaaacaaaaacaaaacacacaacaaaaagaataaagaaaagaaagaagacgcgcaagaggaggagaggcgagagttttctataaaaagagggaaagaagggaaggaccaagacaccaaaagaacgaagacagcggacaacagaaacgagacaccggagagagcaacgggaggaaaaagagaagcataacagcaagtaggggggagctaaaacacaaaagaggagagcacacgcaaacgaccactgaaacaagcgctctgaagcagaagccaactaaagaggggagaaaagcaacagcaccaaagaagcgaagaacgtaacaaagggaatgaacaagcagaacaagacggtagaaaagatcggagcggacagaagaaaaaacaggaaccggggcgtgataaagagacgggagagtagtggtgacggggagagacggacaggtgtccgcgcagcggcggggagaaaaagtggtgaaaagagaggagaggtaggggaaggagaggggaaggcaggcgcaggagcgacaggacggagaaagagagaagaagtaaggtcaaggggcgggcggggagagaggtggagagacagaagacagcaagacgacgaaagacacaggaaggacggggacagtaaaagcaacgcgaagtaccggcgggcgtagaaagaggaggagagcgatacacgattgcagagtaagaccgacagaagagaaaagcaaggaaagagaacggcacgagggaggcagtggcacaagacgagtggagaagacgaacgaaagagggacgaagacccccggggacatcagagagcaagaaacgaag

SEQ ID NO: 369615 - DNA, 2598 bp, Homo sapiens
gatttgctacctccctggagctccctgacccggacgctctctgggccaatatggcagcgcccagcaacaagacagagctggcctggagtccgcggctggccgcgtgagtaggtgattgtctgacaagcagaggcatgagctgggtccaggccaccctactggcccgaggcctctgtagggcctggggaggcacctgcggggccgccctcacaggaacctccatctctcaggtccctcgccggctccctcggggcctccactgcagcgcagctgcccatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggttcctttgcccaaagactcaacaggtgcagcagatcccccccagccccacatcgtaggaatccagagtcccgatcagcaggccgccctggcccgccacaatccagcccggcctgtctttgttgagggccccttctccctgtggctccgcaacaagtgtgtgtagaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgcaaaaaaaaaaaaaaaaaaataaaaaaaaacaaaaaaaaaaaaacaaaaaaaaaaacaaaaaagaacaaaacaacaaaaaagaagagagagagacaacacaacaacaaaagaaaacacacataaagaaagaccaacacaaaacaaaaacaaaacacacaacaaaaagaataaagaaaagaaagaagacgcgcaagaggaggagaggcgagagttttctataaaaagagggaaagaagggaaggaccaagacaccaaaagaacgaagacagcggacaacagaaacgagacaccggagagagcaacgggaggaaaaagagaagcataacagcaagtaggggggagctaaaacacaaaagaggagagcacacgcaaacgaccactgaaacaagcgctctgaagcagaagccaactaaagaggggagaaaagcaacagcaccaaagaagcgaagaacgtaacaaagggaatgaacaagcagaacaagacggtagaaaagatcggagcggacagaagaaaaaacaggaaccggggcgtgataaagagacgggagagtagtggtgacggggagagacggacaggtgtccgcgcagcggcggggagaaaaagtggtgaaaagagaggagaggtaggggaaggagaggggaaggcaggcgcaggagcgacaggacggagaaagagagaagaagtaaggtcaaggggcgggcggggagagaggtggagagacagaagacagcaagacgacgaaagacacaggaaggacggggacagtaaaagcaacgcgaagtaccggcgggcgtagaaagaggaggagagcgatacacgattgcagagtaagaccgacagaagagaaaagcaaggaaagagaacggcacgagggaggcagtggcacaagacgagtggagaagacgaacgaaagagggacgaagacccccggggacatcagagagcaagaaacgaag

SEQ ID NO: 369616 - DNA, 2685 bp, Homo sapiens
gatttgctacctccctggagctccctgacccggacgctctctgggccaatatggcagcgcccagcaacaagacagagctggcctggagtccgcggctggccgcgtgagtaggtgattgtctgacaagcagaggcatgagctgggtccaggccaccctactggcccgaggcctctgtagggcctggggaggcacctgcggggccgccctcacaggaacctccatctctcaggtccctcgccggctccctcggggcctccactgcagcgcagctgcccatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggccccgtgcgctgcccctgacgccgcccgtctccctccccagaggttcctttgcccaaagactcaacaggtgcagcagatcccccccagccccacatcgtaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgcaaaaaaaaaaaaaaaaaaataaaaaaaaacaaaaaaaaaaaaacaaaaaaaaaaacaaaaaagaacaaaacaacaaaaaagaagagagagagacaacacaacaacaaaagaaaacacacataaagaaagaccaacacaaaacaaaaacaaaacacacaacaaaaagaataaagaaaagaaagaagacgcgcaagaggaggagaggcgagagttttctataaaaagagggaaagaagggaaggaccaagacaccaaaagaacgaagacagcggacaacagaaacgagacaccggagagagcaacgggaggaaaaagagaagcataacagcaagtaggggggagctaaaacacaaaagaggagagcacacgcaaacgaccactgaaacaagcgctctgaagcagaagccaactaaagaggggagaaaagcaacagcaccaaagaagcgaagaacgtaacaaagggaatgaacaagcagaacaagacggtagaaaagatcggagcggacagaagaaaaaacaggaaccggggcgtgataaagagacgggagagtagtggtgacggggagagacggacaggtgtccgcgcagcggcggggagaaaaagtggtgaaaagagaggagaggtaggggaaggagaggggaaggcaggcgcaggagcgacaggacggagaaagagagaagaagtaaggtcaaggggcgggcggggagagaggtggagagacagaagacagcaagacgacgaaagacacaggaaggacggggacagtaaaagcaacgcgaagtaccggcgggcgtagaaagaggaggagagcgatacacgattgcagagtaagaccgacagaagagaaaagcaaggaaagagaacggcacgagggaggcagtggcacaagacgagtggagaagacgaacgaaagagggacgaagacccccggggacatcagagagcaagaaacgaag

SEQ ID NO: 369617 - DNA, 2522 bp, Homo sapiens
gatttgctacctccctggagctccctgacccggacgctctctgggccaatatggcagcgcccagcaacaagacagagctggcctggagtccgcggctggccgcgtgagtaggtccctcgccggctccctcggggcctccactgcagcgcagctgcccatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggttcctttgcccaaagactcaacaggtgcagcagatcccccccagccccacatcgtaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgcaaaaaaaaaaaaaaaaaaataaaaaaaaacaaaaaaaaaaaaacaaaaaaaaaaacaaaaaagaacaaaacaacaaaaaagaagagagagagacaacacaacaacaaaagaaaacacacataaagaaagaccaacacaaaacaaaaacaaaacacacaacaaaaagaataaagaaaagaaagaagacgcgcaagaggaggagaggcgagagttttctataaaaagagggaaagaagggaaggaccaagacaccaaaagaacgaagacagcggacaacagaaacgagacaccggagagagcaacgggaggaaaaagagaagcataacagcaagtaggggggagctaaaacacaaaagaggagagcacacgcaaacgaccactgaaacaagcgctctgaagcagaagccaactaaagaggggagaaaagcaacagcaccaaagaagcgaagaacgtaacaaagggaatgaacaagcagaacaagacggtagaaaagatcggagcggacagaagaaaaaacaggaaccggggcgtgataaagagacgggagagtagtggtgacggggagagacggacaggtgtccgcgcagcggcggggagaaaaagtggtgaaaagagaggagaggtaggggaaggagaggggaaggcaggcgcaggagcgacaggacggagaaagagagaagaagtaaggtcaaggggcgggcggggagagaggtggagagacagaagacagcaagacgacgaaagacacaggaaggacggggacagtaaaagcaacgcgaagtaccggcgggcgtagaaagaggaggagagcgatacacgattgcagagtaagaccgacagaagagaaaagcaaggaaagagaacggcacgagggaggcagtggcacaagacgagtggagaagacgaacgaaagagggacgaagacccccggggacatcagagagcaagaaacgaag

SEQ ID NO: 369618 - DNA, 2736 bp, Homo sapiens
gatttgctacctccctggagctccctgacccggacgctctctgggccaatatggcagcgcccagcaacaagacagagctggcctggagtccgcggctggccgcgtgagtagagacagggtttctccatgttggtcaggctggtctcgaactcccgacctcaggtgatcagctggcctggacctcccaacgtgctgggattacacacgtgattgtctgacaagcagaggcatgagctgggtccaggccaccctactggcccgaggcctctgtagggcctggggaggcacctgcggggccgccctcacaggaacctccatctctcaggtccctcgccggctccctcggggcctccactgcagcgcagctgcccatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggttcctttgcccaaagactcaacaggtgcagcagatcccccccagccccacatcgtaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgcaaaaaaaaaaaaaaaaaaataaaaaaaaacaaaaaaaaaaaaacaaaaaaaaaaacaaaaaagaacaaaacaacaaaaaagaagagagagagacaacacaacaacaaaagaaaacacacataaagaaagaccaacacaaaacaaaaacaaaacacacaacaaaaagaataaagaaaagaaagaagacgcgcaagaggaggagaggcgagagttttctataaaaagagggaaagaagggaaggaccaagacaccaaaagaacgaagacagcggacaacagaaacgagacaccggagagagcaacgggaggaaaaagagaagcataacagcaagtaggggggagctaaaacacaaaagaggagagcacacgcaaacgaccactgaaacaagcgctctgaagcagaagccaactaaagaggggagaaaagcaacagcaccaaagaagcgaagaacgtaacaaagggaatgaacaagcagaacaagacggtagaaaagatcggagcggacagaagaaaaaacaggaaccggggcgtgataaagagacgggagagtagtggtgacggggagagacggacaggtgtccgcgcagcggcggggagaaaaagtggtgaaaagagaggagaggtaggggaaggagaggggaaggcaggcgcaggagcgacaggacggagaaagagagaagaagtaaggtcaaggggcgggcggggagagaggtggagagacagaagacagcaagacgacgaaagacacaggaaggacggggacagtaaaagcaacgcgaagtaccggcgggcgtagaaagaggaggagagcgatacacgattgcagagtaagaccgacagaagagaaaagcaaggaaagagaacggcacgagggaggcagtggcacaagacgagtggagaagacgaacgaaagagggacgaagacccccggggacatcagagagcaagaaacgaag

SEQ ID NO: 369619 - DNA, 2693 bp, Homo sapiens
ggctggtacgcccggaagtatgggatgacagagctggctggagtcgcggctggccgcgtgagtagtggagacagggtttctccatgttggtcaggctggtctcgaactcccgacctcaggtgatcagctggcctggacctcccaacgtgctgggattacacacgtgattgtctgacaagcagaggcatgagctgggtccaggccaccctactggcccgaggcctctgtagggcctggggaggcacctgcggggccgccctcacaggaacctccatctctcaggtccctcgccggctccctcggggcctccactgcagcgcagctgcccatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggttcctttgcccaaagactcaacaggtgcagcagatcccccccagccccacatcgtaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgcaaaaaaaaaaaaaaaaaaataaaaaaaaacaaaaaaaaaaaaacaaaaaaaaaaacaaaaaagaacaaaacaacaaaaaagaagagagagagacaacacaacaacaaaagaaaacacacataaagaaagaccaacacaaaacaaaaacaaaacacacaacaaaaagaataaagaaaagaaagaagacgcgcaagaggaggagaggcgagagttttctataaaaagagggaaagaagggaaggaccaagacaccaaaagaacgaagacagcggacaacagaaacgagacaccggagagagcaacgggaggaaaaagagaagcataacagcaagtaggggggagctaaaacacaaaagaggagagcacacgcaaacgaccactgaaacaagcgctctgaagcagaagccaactaaagaggggagaaaagcaacagcaccaaagaagcgaagaacgtaacaaagggaatgaacaagcagaacaagacggtagaaaagatcggagcggacagaagaaaaaacaggaaccggggcgtgataaagagacgggagagtagtggtgacggggagagacggacaggtgtccgcgcagcggcggggagaaaaagtggtgaaaagagaggagaggtaggggaaggagaggggaaggcaggcgcaggagcgacaggacggagaaagagagaagaagtaaggtcaaggggcgggcggggagagaggtggagagacagaagacagcaagacgacgaaagacacaggaaggacggggacagtaaaagcaacgcgaagtaccggcgggcgtagaaagaggaggagagcgatacacgattgcagagtaagaccgacagaagagaaaagcaaggaaagagaacggcacgagggaggcagtggcacaagacgagtggagaagacgaacgaaagagggacgaagacccccggggacatcagagagcaagaaacgaag

SEQ ID NO: 369620 - DNA, 2662 bp, Homo sapiens
gatttgctacctccctggagctccctgacccggacgctctctgggccaatatggcagcgcccagcaacaagacagagctggcctggagtccgcggctggccgcgtgagtaggtccctcgccggctccctcggggcctccactgcagcgcagctgcccatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggttcctttgcccaaagactcaacaggtgcagcagatcccccccagccccacatcgtaggtaagtccgagagcatgggggcagccaagtctctaaccttacccaggccctgccaggttctcgctgggcctaggctgggctccctgggcctctgggccgagtcccttgcagggcacagggcatgtatgtctccacaccaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgcaaaaaaaaaaaaaaaaaaataaaaaaaaacaaaaaaaaaaaaacaaaaaaaaaaacaaaaaagaacaaaacaacaaaaaagaagagagagagacaacacaacaacaaaagaaaacacacataaagaaagaccaacacaaaacaaaaacaaaacacacaacaaaaagaataaagaaaagaaagaagacgcgcaagaggaggagaggcgagagttttctataaaaagagggaaagaagggaaggaccaagacaccaaaagaacgaagacagcggacaacagaaacgagacaccggagagagcaacgggaggaaaaagagaagcataacagcaagtaggggggagctaaaacacaaaagaggagagcacacgcaaacgaccactgaaacaagcgctctgaagcagaagccaactaaagaggggagaaaagcaacagcaccaaagaagcgaagaacgtaacaaagggaatgaacaagcagaacaagacggtagaaaagatcggagcggacagaagaaaaaacaggaaccggggcgtgataaagagacgggagagtagtggtgacggggagagacggacaggtgtccgcgcagcggcggggagaaaaagtggtgaaaagagaggagaggtaggggaaggagaggggaaggcaggcgcaggagcgacaggacggagaaagagagaagaagtaaggtcaaggggcgggcggggagagaggtggagagacagaagacagcaagacgacgaaagacacaggaaggacggggacagtaaaagcaacgcgaagtaccggcgggcgtagaaagaggaggagagcgatacacgattgcagagtaagaccgacagaagagaaaagcaaggaaagagaacggcacgagggaggcagtggcacaagacgagtggagaagacgaacgaaagagggacgaagacccccggggacatcagagagcaagaaacgaag

SEQ ID NO: 369621 - DNA, 2706 bp, Homo sapiens
gatttgctacctccctggagctccctgacccggacgctctctgggccaatatggcagcgcccagcaacaagacagagctggcctggagtccgcggctggccgcgtgagtaggtccctcgccggctccctcggggcctccactgcagcgcagctgcccatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggccccgtgcgctgcccctgacgccgcccgtctccctccccagaggttcctttgcccaaagactcaacaggtgcagcagatcccccccagccccacatcgtaggtaagtccgagagcatgggggcagccaagtctctaaccttacccaggccctgccaggttctcgctgggcctaggctgggctccctgggcctctgggccgagtcccttgcagggcacagggcatgtatgtctccacaccaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgcaaaaaaaaaaaaaaaaaaataaaaaaaaacaaaaaaaaaaaaacaaaaaaaaaaacaaaaaagaacaaaacaacaaaaaagaagagagagagacaacacaacaacaaaagaaaacacacataaagaaagaccaacacaaaacaaaaacaaaacacacaacaaaaagaataaagaaaagaaagaagacgcgcaagaggaggagaggcgagagttttctataaaaagagggaaagaagggaaggaccaagacaccaaaagaacgaagacagcggacaacagaaacgagacaccggagagagcaacgggaggaaaaagagaagcataacagcaagtaggggggagctaaaacacaaaagaggagagcacacgcaaacgaccactgaaacaagcgctctgaagcagaagccaactaaagaggggagaaaagcaacagcaccaaagaagcgaagaacgtaacaaagggaatgaacaagcagaacaagacggtagaaaagatcggagcggacagaagaaaaaacaggaaccggggcgtgataaagagacgggagagtagtggtgacggggagagacggacaggtgtccgcgcagcggcggggagaaaaagtggtgaaaagagaggagaggtaggggaaggagaggggaaggcaggcgcaggagcgacaggacggagaaagagagaagaagtaaggtcaaggggcgggcggggagagaggtggagagacagaagacagcaagacgacgaaagacacaggaaggacggggacagtaaaagcaacgcgaagtaccggcgggcgtagaaagaggaggagagcgatacacgattgcagagtaagaccgacagaagagaaaagcaaggaaagagaacggcacgagggaggcagtggcacaagacgagtggagaagacgaacgaaagagggacgaagacccccggggacatcagagagcaagaaacgaag

SEQ ID NO: 369622 - DNA, 1999 bp, Homo sapiens
gatttgctacctccctggagctccctgacccggacgctctctgggccaatatggcagcgcccagcaacaagacagagctggcctggagtccgcggctggccgcgtgagtaggtgattgtctgacaagcagaggcatgagctgggtccaggccaccctactggcccgaggcctctgtagggcctggggaggcacctgcggggccgccctcacaggaacctccatctctcaggttcctttgcccaaagactcaacaggtgcagcagatcccccccagccccacatcgtaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgcaaaaaaaaaaaaaaaaaaataaaaaaaaacaaaaaaaaaaaaacaaaaaaaaaaacaaaaaagaacaaaacaacaaaaaagaagagagagagacaacacaacaacaaaagaaaacacacataaagaaagaccaacacaaaacaaaaacaaaacacacaacaaaaagaataaagaaaagaaagaagacgcgcaagaggaggagaggcgagagttttctataaaaagagggaaagaagggaaggaccaagacaccaaaagaacgaagacagcggacaacagaaacgagacaccggagagagcaacgggaggaaaaagagaagcataacagcaagtaggggggagctaaaacacaaaagaggagagcacacgcaaacgaccactgaaacaagcgctctgaagcagaagccaactaaagaggggagaaaagcaacagcaccaaagaagcgaagaacgtaacaaagggaatgaacaagcagaacaagacggtagaaaagatcggagcggacagaagaaaaaacaggaaccggggcgtgataaagagacgggagagtagtggtgacggggagagacggacaggtgtccgcgcagcggcggggagaaaaagtggtgaaaagagaggagaggtaggggaaggagaggggaaggcaggcgcaggagcgacaggacggagaaagagagaagaagtaaggtcaaggggcgggcggggagagaggtggagagacagaagacagcaagacgacgaaagacacaggaaggacggggacagtaaaagcaacgcgaagtaccggcgggcgtagaaagaggaggagagcgatacacgattgcagagtaagaccgacagaagagaaaagcaaggaaagagaacggcacgagggaggcagtggcacaagacgagtggagaagacgaacgaaagagggacgaagacccccggggacatcagagagcaagaaacgaag

SEQ ID NO: 369623 - DNA, 1850 bp, Homo sapiens
gatttgctacctccctggagctccctgacccggacgctctctgggccaatatggcagcgcccagcaacaagacagagctggcctggagtccgcggctggccgcgtgagtaggtgattgtctgacaagcagaggcatgagctgggtccaggccaccctactggcccgaggcctctgtagggcctggggaggcacctgcggggccgccctcacaggaacctccatctctcaggttcctttgcccaaagactcaacaggtgcagcagatcccccccagccccacatcgtaggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgcaaaaaaaaaaaaaaaaaaataaaaaaaaacaaaaaaaaaaaaacaaaaaaaaaaacaaaaaagaacaaaacaacaaaaaagaagagagagagacaacacaacaacaaaagaaaacacacataaagaaagaccaacacaaaacaaaaacaaaacacacaacaaaaagaataaagaaaagaaagaagacgcgcaagaggaggagaggcgagagttttctataaaaagagggaaagaagggaaggaccaagacaccaaaagaacgaagacagcggacaacagaaacgagacaccggagagagcaacgggaggaaaaagagaagcataacagcaagtaggggggagctaaaacacaaaagaggagagcacacgcaaacgaccactgaaacaagcgctctgaagcagaagccaactaaagaggggagaaaagcaacagcaccaaagaagcgaagaacgtaacaaagggaatgaacaagcagaacaagacggtagaaaagatcggagcggacagaagaaaaaacaggaaccggggcgtgataaagagacgggagagtagtggtgacggggagagacggacaggtgtccgcgcagcggcggggagaaaaagtggtgaaaagagaggagaggtaggggaaggagaggggaaggcaggcgcaggagcgacaggacggagaaagagagaagaagtaaggtcaaggggcgggcggggagagaggtggagagacagaagacagcaagacgacgaaagacacaggaaggacggggacagtaaaagcaacgcgaagtaccggcgggcgtagaaagaggaggagagcgatacacgattgcagagtaagaccgacagaagagaaaagcaaggaaagagaacggcacgagggaggcagtggcacaagacgagtggagaagacgaacgaaagagggacgaagacccccggggacatcagagagcaagaaacgaag

SEQ ID NO: 369624 - DNA, 1218 bp, Homo sapiens
aggcggtggactgaaggcatgaaatgccctttgagtgtacagcaaatcaatgttttcctgcttggggctttcttccctcatttcatgaccaggcgacgatggctaagtggatccagggcctgcaggagaccaacccaaccctggcccagatccccgtggtcttccgcctcgccgggtccacccgggagctccagaatctgcaggcgcctctggttctccgaattcaaataaaaaggggcgggagcgctgttggttgtgcgcaaaaaaaaaaaaaaaaaaataaaaaaaaacaaaaaaaaaaaaacaaaaaaaaaaacaaaaaagaacaaaacaacaaaaaagaagagagagagacaacacaacaacaaaagaaaacacacataaagaaagaccaacacaaaacaaaaacaaaacacacaacaaaaagaataaagaaaagaaagaagacgcgcaagaggaggagaggcgagagttttctataaaaagagggaaagaagggaaggaccaagacaccaaaagaacgaagacagcggacaacagaaacgagacaccggagagagcaacgggaggaaaaagagaagcataacagcaagtaggggggagctaaaacacaaaagaggagagcacacgcaaacgaccactgaaacaagcgctctgaagcagaagccaactaaagaggggagaaaagcaacagcaccaaagaagcgaagaacgtaacaaagggaatgaacaagcagaacaagacggtagaaaagatcggagcggacagaagaaaaaacaggaaccggggcgtgataaagagacgggagagtagtggtgacggggagagacggacaggtgtccgcgcagcggcggggagaaaaagtggtgaaaagagaggagaggtaggggaaggagaggggaaggcaggcgcaggagcgacaggacggagaaagagagaagaagtaaggtcaaggggcgggcggggagagaggtggagagacagaagacagcaagacgacgaaagacacaggaaggacggggacagtaaaagcaacgcgaagtaccggcgggcgtagaaagaggaggagagcgatacacgattgcagagtaagaccgacagaagagaaaagcaaggaaagagaacggcacgagggaggcagtggcacaagacgagtggagaagacgaacgaaagagggacgaagacccccggggacatcagagagcaagaaacgaag

SEQ ID NO: 369625 - DNA, 2641 bp, Homo sapiens
gatttgctacctccctggagctccctgacccggacgctctctgggccaatatggcagcgcccagcaacaagacagagctggcctggagtccgcggctggccgcgtgagtaggtgattgtctgacaagcagaggcatgagctgggtccaggccaccctactggcccgaggcctctgtagggcctggggaggcacctgcggggccgccctcacaggaacctccatctctcaggtccctcgccggctccctcggggcctccactgcagcgcagctgcccatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggttcctttgcccaaagactcaacaggtgcagcagatcccccccagccccacatcgtaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgcaaaaaaaaaaaaaaaaaaataaaaaaaaacaaaaaaaaaaaaacaaaaaaaaaaacaaaaaagaacaaaacaacaaaaaagaagagagagagacaacacaacaacaaaagaaaacacacataaagaaagaccaacacaaaacaaaaacaaaacacacaacaaaaagaataaagaaaagaaagaagacgcgcaagaggaggagaggcgagagttttctataaaaagagggaaagaagggaaggaccaagacaccaaaagaacgaagacagcggacaacagaaacgagacaccggagagagcaacgggaggaaaaagagaagcataacagcaagtaggggggagctaaaacacaaaagaggagagcacacgcaaacgaccactgaaacaagcgctctgaagcagaagccaactaaagaggggagaaaagcaacagcaccaaagaagcgaagaacgtaacaaagggaatgaacaagcagaacaagacggtagaaaagatcggagcggacagaagaaaaaacaggaaccggggcgtgataaagagacgggagagtagtggtgacggggagagacggacaggtgtccgcgcagcggcggggagaaaaagtggtgaaaagagaggagaggtaggggaaggagaggggaaggcaggcgcaggagcgacaggacggagaaagagagaagaagtaaggtcaaggggcgggcggggagagaggtggagagacagaagacagcaagacgacgaaagacacaggaaggacggggacagtaaaagcaacgcgaagtaccggcgggcgtagaaagaggaggagagcgatacacgattgcagagtaagaccgacagaagagaaaagcaaggaaagagaacggcacgagggaggcagtggcacaagacgagtggagaagacgaacgaaagagggacgaagacccccggggacatcagagagcaagaaacgaag

SEQ ID NO: 369626 - DNA, 2492 bp, Homo sapiens
gatttgctacctccctggagctccctgacccggacgctctctgggccaatatggcagcgcccagcaacaagacagagctggcctggagtccgcggctggccgcgtgagtaggtgattgtctgacaagcagaggcatgagctgggtccaggccaccctactggcccgaggcctctgtagggcctggggaggcacctgcggggccgccctcacaggaacctccatctctcaggtccctcgccggctccctcggggcctccactgcagcgcagctgcccatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggttcctttgcccaaagactcaacaggtgcagcagatcccccccagccccacatcgtaggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgcaaaaaaaaaaaaaaaaaaataaaaaaaaacaaaaaaaaaaaaacaaaaaaaaaaacaaaaaagaacaaaacaacaaaaaagaagagagagagacaacacaacaacaaaagaaaacacacataaagaaagaccaacacaaaacaaaaacaaaacacacaacaaaaagaataaagaaaagaaagaagacgcgcaagaggaggagaggcgagagttttctataaaaagagggaaagaagggaaggaccaagacaccaaaagaacgaagacagcggacaacagaaacgagacaccggagagagcaacgggaggaaaaagagaagcataacagcaagtaggggggagctaaaacacaaaagaggagagcacacgcaaacgaccactgaaacaagcgctctgaagcagaagccaactaaagaggggagaaaagcaacagcaccaaagaagcgaagaacgtaacaaagggaatgaacaagcagaacaagacggtagaaaagatcggagcggacagaagaaaaaacaggaaccggggcgtgataaagagacgggagagtagtggtgacggggagagacggacaggtgtccgcgcagcggcggggagaaaaagtggtgaaaagagaggagaggtaggggaaggagaggggaaggcaggcgcaggagcgacaggacggagaaagagagaagaagtaaggtcaaggggcgggcggggagagaggtggagagacagaagacagcaagacgacgaaagacacaggaaggacggggacagtaaaagcaacgcgaagtaccggcgggcgtagaaagaggaggagagcgatacacgattgcagagtaagaccgacagaagagaaaagcaaggaaagagaacggcacgagggaggcagtggcacaagacgagtggagaagacgaacgaaagagggacgaagacccccggggacatcagagagcaagaaacgaag

SEQ ID NO: 369627 - DNA, 2781 bp, Homo sapiens
gatttgctacctccctggagctccctgacccggacgctctctgggccaatatggcagcgcccagcaacaagacagagctggcctggagtccgcggctggccgcgtgagtaggtgattgtctgacaagcagaggcatgagctgggtccaggccaccctactggcccgaggcctctgtagggcctggggaggcacctgcggggccgccctcacaggaacctccatctctcaggtccctcgccggctccctcggggcctccactgcagcgcagctgcccatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggttcctttgcccaaagactcaacaggtgcagcagatcccccccagccccacatcgtaggtaagtccgagagcatgggggcagccaagtctctaaccttacccaggccctgccaggttctcgctgggcctaggctgggctccctgggcctctgggccgagtcccttgcagggcacagggcatgtatgtctccacaccaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgcaaaaaaaaaaaaaaaaaaataaaaaaaaacaaaaaaaaaaaaacaaaaaaaaaaacaaaaaagaacaaaacaacaaaaaagaagagagagagacaacacaacaacaaaagaaaacacacataaagaaagaccaacacaaaacaaaaacaaaacacacaacaaaaagaataaagaaaagaaagaagacgcgcaagaggaggagaggcgagagttttctataaaaagagggaaagaagggaaggaccaagacaccaaaagaacgaagacagcggacaacagaaacgagacaccggagagagcaacgggaggaaaaagagaagcataacagcaagtaggggggagctaaaacacaaaagaggagagcacacgcaaacgaccactgaaacaagcgctctgaagcagaagccaactaaagaggggagaaaagcaacagcaccaaagaagcgaagaacgtaacaaagggaatgaacaagcagaacaagacggtagaaaagatcggagcggacagaagaaaaaacaggaaccggggcgtgataaagagacgggagagtagtggtgacggggagagacggacaggtgtccgcgcagcggcggggagaaaaagtggtgaaaagagaggagaggtaggggaaggagaggggaaggcaggcgcaggagcgacaggacggagaaagagagaagaagtaaggtcaaggggcgggcggggagagaggtggagagacagaagacagcaagacgacgaaagacacaggaaggacggggacagtaaaagcaacgcgaagtaccggcgggcgtagaaagaggaggagagcgatacacgattgcagagtaagaccgacagaagagaaaagcaaggaaagagaacggcacgagggaggcagtggcacaagacgagtggagaagacgaacgaaagagggacgaagacccccggggacatcagagagcaagaaacgaag

SEQ ID NO: 369628 - DNA, 1239 bp, Homo sapiens
gatttgctacctccctggagctccctgacccggacgctctctgggccaatatggcagcgcccagcaacaagacagagctggcctggagtccgcggctggccgcgtgagtaggtgattgtctgacaagcagaggcatgagctgggtccaggccaccctactggcccgaggcctctgtagggcctggggaggcacctgcggggccgccctcacaggaacctccatctctcaggtccctcgccggctccctcggggcctccactgcagcgcagctgcccatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggttcctttgcccaaagactcaacaggtgcagcagatcccccccagccccacatcgtaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggaagtggaagagacgccggaggagtggaacctctactacccgatgcagctggacctggagtatgtgaggagtggctgggacaactacgagtttgacatcaatgaagcttggagctgcccaattcatggatcactgctctaataaactcctaaatattttg

SEQ ID NO: 369629 - DNA, 2833 bp, Homo sapiens
gggtaggcgaacgcgaactgctgggctgcaggcgggcccttcaggacccggcagcgcgagagggcagccctggagggacccagctgcagggccaggcgccatgacctttcgtagtgggggcggggacgcgctgggaaaggccgcctgtcttgtgccagccgcctcacgcccccagtctcccattttgcagatgacctcgcgagaggtcacgccgcaagtcggcaaccgggcaggatttggaatccgcgtctgcctttttcccccaagagacccagaatcctggcagccggtttcaaagctgttgtgattgtctgacaagcagaggcatgagctgggtccaggccaccctactggcccgaggcctctgtagggcctggggaggcacctgcggggccgccctcacaggaacctccatctctcaggtccctcgccggctccctcggggcctccactgcagcgcagctgcccatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggttcctttgcccaaagactcaacaggtgcagcagatcccccccagccccacatcgtaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgcaaaaaaaaaaaaaaaaaaataaaaaaaaacaaaaaaaaaaaaacaaaaaaaaaaacaaaaaagaacaaaacaacaaaaaagaagagagagagacaacacaacaacaaaagaaaacacacataaagaaagaccaacacaaaacaaaaacaaaacacacaacaaaaagaataaagaaaagaaagaagacgcgcaagaggaggagaggcgagagttttctataaaaagagggaaagaagggaaggaccaagacaccaaaagaacgaagacagcggacaacagaaacgagacaccggagagagcaacgggaggaaaaagagaagcataacagcaagtaggggggagctaaaacacaaaagaggagagcacacgcaaacgaccactgaaacaagcgctctgaagcagaagccaactaaagaggggagaaaagcaacagcaccaaagaagcgaagaacgtaacaaagggaatgaacaagcagaacaagacggtagaaaagatcggagcggacagaagaaaaaacaggaaccggggcgtgataaagagacgggagagtagtggtgacggggagagacggacaggtgtccgcgcagcggcggggagaaaaagtggtgaaaagagaggagaggtaggggaaggagaggggaaggcaggcgcaggagcgacaggacggagaaagagagaagaagtaaggtcaaggggcgggcggggagagaggtggagagacagaagacagcaagacgacgaaagacacaggaaggacggggacagtaaaagcaacgcgaagtaccggcgggcgtagaaagaggaggagagcgatacacgattgcagagtaagaccgacagaagagaaaagcaaggaaagagaacggcacgagggaggcagtggcacaagacgagtggagaagacgaacgaaagagggacgaagacccccggggacatcagagagcaagaaacgaag

SEQ ID NO: 369630 - DNA, 2714 bp, Homo sapiens
gggtaggcgaacgcgaactgctgggctgcaggcgggcccttcaggacccggcagcgcgagagggcagccctggagggacccagctgcagggccaggcgccatgacctttcgtagtgggggcggggacgcgctgggaaaggccgcctgtcttgtgccagccgcctcacgcccccagtctcccattttgcagatgacctcgcgagaggtcacgccgcaagtcggcaaccgggcaggatttggaatccgcgtctgcctttttcccccaagagacccagaatcctggcagccggtttcaaagctgttgtccctcgccggctccctcggggcctccactgcagcgcagctgcccatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggttcctttgcccaaagactcaacaggtgcagcagatcccccccagccccacatcgtaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgcaaaaaaaaaaaaaaaaaaataaaaaaaaacaaaaaaaaaaaaacaaaaaaaaaaacaaaaaagaacaaaacaacaaaaaagaagagagagagacaacacaacaacaaaagaaaacacacataaagaaagaccaacacaaaacaaaaacaaaacacacaacaaaaagaataaagaaaagaaagaagacgcgcaagaggaggagaggcgagagttttctataaaaagagggaaagaagggaaggaccaagacaccaaaagaacgaagacagcggacaacagaaacgagacaccggagagagcaacgggaggaaaaagagaagcataacagcaagtaggggggagctaaaacacaaaagaggagagcacacgcaaacgaccactgaaacaagcgctctgaagcagaagccaactaaagaggggagaaaagcaacagcaccaaagaagcgaagaacgtaacaaagggaatgaacaagcagaacaagacggtagaaaagatcggagcggacagaagaaaaaacaggaaccggggcgtgataaagagacgggagagtagtggtgacggggagagacggacaggtgtccgcgcagcggcggggagaaaaagtggtgaaaagagaggagaggtaggggaaggagaggggaaggcaggcgcaggagcgacaggacggagaaagagagaagaagtaaggtcaaggggcgggcggggagagaggtggagagacagaagacagcaagacgacgaaagacacaggaaggacggggacagtaaaagcaacgcgaagtaccggcgggcgtagaaagaggaggagagcgatacacgattgcagagtaagaccgacagaagagaaaagcaaggaaagagaacggcacgagggaggcagtggcacaagacgagtggagaagacgaacgaaagagggacgaagacccccggggacatcagagagcaagaaacgaag

SEQ ID NO: 369631 - DNA, 2598 bp, Homo sapiens
gatttgctacctccctggagctccctgacccggacgctctctgggccaatatggcagcgcccagcaacaagacagagctggcctggagtccgcggctggccgcgtgagtaggtgattgtctgacaagcagaggcatgagctgggtccaggccaccctactggcccgaggcctctgtagggcctggggaggcacctgcggggccgccctcacaggaacctccatctctcaggtccctcgccggctccctcggggcctccactgcagcgcagctgcccatagctctgaacagtccctggttcccagcccaccggaaccccggcagaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggttcctttgcccaaagactcaacaggtgcagcagatcccccccagccccacatcgtaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgcaaaaaaaaaaaaaaaaaaataaaaaaaaacaaaaaaaaaaaaacaaaaaaaaaaacaaaaaagaacaaaacaacaaaaaagaagagagagagacaacacaacaacaaaagaaaacacacataaagaaagaccaacacaaaacaaaaacaaaacacacaacaaaaagaataaagaaaagaaagaagacgcgcaagaggaggagaggcgagagttttctataaaaagagggaaagaagggaaggaccaagacaccaaaagaacgaagacagcggacaacagaaacgagacaccggagagagcaacgggaggaaaaagagaagcataacagcaagtaggggggagctaaaacacaaaagaggagagcacacgcaaacgaccactgaaacaagcgctctgaagcagaagccaactaaagaggggagaaaagcaacagcaccaaagaagcgaagaacgtaacaaagggaatgaacaagcagaacaagacggtagaaaagatcggagcggacagaagaaaaaacaggaaccggggcgtgataaagagacgggagagtagtggtgacggggagagacggacaggtgtccgcgcagcggcggggagaaaaagtggtgaaaagagaggagaggtaggggaaggagaggggaaggcaggcgcaggagcgacaggacggagaaagagagaagaagtaaggtcaaggggcgggcggggagagaggtggagagacagaagacagcaagacgacgaaagacacaggaaggacggggacagtaaaagcaacgcgaagtaccggcgggcgtagaaagaggaggagagcgatacacgattgcagagtaagaccgacagaagagaaaagcaaggaaagagaacggcacgagggaggcagtggcacaagacgagtggagaagacgaacgaaagagggacgaagacccccggggacatcagagagcaagaaacgaag

SEQ ID NO: 369632 - DNA, 2417 bp, Homo sapiens
gatttgctacctccctggagctccctgacccggacgctctctgggccaatatggcagcgcccagcaacaagacagagctggcctggagtccgcggctggccgcgtgagtaggtgattgtctgacaagcagaggcatgagctgggtccaggccaccctactggcccgaggcctctgtagggcctggggaggcacctgcggggccgccctcacaggaacctccatctctcaggtccctcgccggctccctcggggcctccactgcagcgcagctgcccatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggttcctttgcccaaagactcaacaggtgcagcagatcccccccagccccacatcgtaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgcaaaaaaaaaaaaaaaaaaataaaaaaaaacaaaaaaaaaaaaacaaaaaaaaaaacaaaaaagaacaaaacaacaaaaaagaagagagagagacaacacaacaacaaaagaaaacacacataaagaaagaccaacacaaaacaaaaacaaaacacacaacaaaaagaataaagaaaagaaagaagacgcgcaagaggaggagaggcgagagttttctataaaaagagggaaagaagggaaggaccaagacaccaaaagaacgaagacagcggacaacagaaacgagacaccggagagagcaacgggaggaaaaagagaagcataacagcaagtaggggggagctaaaacacaaaagaggagagcacacgcaaacgaccactgaaacaagcgctctgaagcagaagccaactaaagaggggagaaaagcaacagcaccaaagaagcgaagaacgtaacaaagggaatgaacaagcagaacaagacggtagaaaagatcggagcggacagaagaaaaaacaggaaccggggcgtgataaagagacgggagagtagtggtgacggggagagacggacaggtgtccgcgcagcggcggggagaaaaagtggtgaaaagagaggagaggtaggggaaggagaggggaaggcaggcgcaggagcgacaggacggagaaagagagaagaagtaaggtcaaggggcgggcggggagagaggtggagagacagaagacagcaagacgacgaaagacacaggaaggacggggacagtaaaagcaacgcgaagtaccggcgggcgtagaaagaggaggagagcgatacacgattgcagagtaagaccgacagaagagaaaagcaaggaaagagaacggcacgagggaggcagtggcacaagacgagtggagaagacgaacgaaagagggacgaagacccccggggacatcagagagcaagaaacgaag

SEQ ID NO: 369633 - DNA, 1880 bp, Homo sapiens
gatttgctacctccctggagctccctgacccggacgctctctgggccaatatggcagcgcccagcaacaagacagagctggcctggagtccgcggctggccgcgtgagtaggttcctttgcccaaagactcaacaggtgcagcagatcccccccagccccacatcgtaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgcaaaaaaaaaaaaaaaaaaataaaaaaaaacaaaaaaaaaaaaacaaaaaaaaaaacaaaaaagaacaaaacaacaaaaaagaagagagagagacaacacaacaacaaaagaaaacacacataaagaaagaccaacacaaaacaaaaacaaaacacacaacaaaaagaataaagaaaagaaagaagacgcgcaagaggaggagaggcgagagttttctataaaaagagggaaagaagggaaggaccaagacaccaaaagaacgaagacagcggacaacagaaacgagacaccggagagagcaacgggaggaaaaagagaagcataacagcaagtaggggggagctaaaacacaaaagaggagagcacacgcaaacgaccactgaaacaagcgctctgaagcagaagccaactaaagaggggagaaaagcaacagcaccaaagaagcgaagaacgtaacaaagggaatgaacaagcagaacaagacggtagaaaagatcggagcggacagaagaaaaaacaggaaccggggcgtgataaagagacgggagagtagtggtgacggggagagacggacaggtgtccgcgcagcggcggggagaaaaagtggtgaaaagagaggagaggtaggggaaggagaggggaaggcaggcgcaggagcgacaggacggagaaagagagaagaagtaaggtcaaggggcgggcggggagagaggtggagagacagaagacagcaagacgacgaaagacacaggaaggacggggacagtaaaagcaacgcgaagtaccggcgggcgtagaaagaggaggagagcgatacacgattgcagagtaagaccgacagaagagaaaagcaaggaaagagaacggcacgagggaggcagtggcacaagacgagtggagaagacgaacgaaagagggacgaagacccccggggacatcagagagcaagaaacgaag

SEQ ID NO: 369634 - DNA, 476 bp, Homo sapiens
cccaacagggagattcgctgtgttaagaactcgagctgttgctattattctaagagactgggtagccagtcaaagggttaaaacagcccttcctacaaggatttgaaaactctgtgctctgctcttcctcagcagacttctcgttgtgagtattggcatttatttctgattatgcacttcccctctttcttgaatgagttgggtgggctagctgagcccatcaaaggtatagctcatttgcttccttttccagggtttgccttcttcctgtgtctgggataattttcagttcatctcctttgtgcagtttctgagaaaggtttgtatgggcttagaggaaaatgatcgtgactaaagctcacagtcaccgctttggctccttttctataaaaggtggtttgatttgatctggcatgaaaaatattatcataattctcaaattcacagaaacgataagttcttgctctttcctgacc

SEQ ID NO: 369635 - DNA, 1080 bp, Homo sapiens
gcaaaccctgaaacagctttgcagaaaaaagggcagatagatggggtgagaactcccaagactgctgaaaatatacctgactttactggttgaattaagaaataagtaatacaagaaaaacacctaagaacagaatcatcagtcctttaatccattctgatgaccatattttcatgtctgctcttaggaccacccagccttctgggccctccccccatggccaatggaaaacctggcgaccctaagtcaggtgaggaggaaggggccctgatccttgtattaggtcgtagagaagacagcaagggaggggataaaacccaggaaggacttaaaaataaaagatcagggattccatccctaaatgaatggagagaagttgtatatttgctgatttaaaaactcaatgttgtaaaaatgtcacttcttcccaaattgataaacagatttcatgcattccaagtcagaacacccataatgtttttgtggaaatacacattattatagggaaatgcaaaatatcaaggcgactatcaagacaatcttgaagtgggagggcttactatgaatatcaagatttgtaagctgggcatggtggcacacgcctgtagtcccagttactcaggaggctgaggtgcgaggatcctttgagcccaggagtttttgaggccactctgggcaacatagtgagatcctgtctctaaatacaagaagaaaaaaaagacttactataaagctacaatagttacaacgatgcagtttggaaacaatgatagacataagtcaataggacttatgtcccgaagagtccaataacaggcccatacatgtgtggacacttcatttatgatgaagatggaactgaaaagttggtcttttcaataaatgatattggatcaattggatattcatgtgaaaaaaatggaatttcaccttgcactcataatcatatacaaagatctatttcaaatggactgtagatctaagtataaaaggtaagagaataattattctagaaagtaaatgtattttctaagagtagctaagagttcttaaacagacaagaaatgcacgtatacacac

SEQ ID NO: 369636 - DNA, 1114 bp, Homo sapiens
ggcggggcctactacctaggggagagggggcgtggacacgctgaggctatactacaaagccccgggcttgaccttagtggaaagccgagactgcgtccaggttgctggactacaccgggggcacggtcagaggtctttaggggagggcggcggtctgagagtcctgggtgccgacctgttgggacccaaattccttgtgggaacgatgataaggagcaggtttacagatcataagtgcaaaagcgggcgagaagggaaacccaagcgggacaaggacttttggggggaggtcaaagggcacgaagttgtgcctgcagctgttaccatagtaaccgaggaccggatgtggcgatcttacggtgcgacagtcctcttctcaggccctctggcccgagagcctgttgactctgtgacacactctgaggagctggttgtggtgttttccagcgagggaagaaaagagtaattttttcaaagcatttatagaaacgcagcaaagggaaggtgtgaggttgccgccatgcctggcagagacggagggaggcagttggctccggaatgcggccgccgcagatgttctccgcaaccttccggaagtggaatggcgggagcctcagcattgctgcccaccgaccccccggaagcggaaacagaatccccgcgtgccccttcctcactaccctccaaatcccgctgcagccattgccgcagacacgatgccgaaacgaaagaagcagaatcatcaccagccaccgacacagcagcagcccccgctgcccgagcgggaagagactggagatgaggaggatgggagtcccatcggtgaggggtctgggagggatgtgcacatgcctgtcaagcccgtccgggcaaggggctaggggctaataaggtgcgaaggagggggctgtaacggaaggaggaagggcgcacgcgctggggagggatggaagtggggctctcccaaatggagccttgaaccaggagttctcttactggaaccatcaacctcaatacggccccagacctttctggagaaggcgggggtggagagaataaagagctcttttgcgcagccgcagaacagtaggggaaaggggtagtagagatgttg

SEQ ID NO: 369637 - DNA, 2474 bp, Homo sapiens
ggcggggcctactacctaggggagagggggcgtggacacgctgaggctatactacaaagccccgggcttgaccttagtggaaagccgagactgcgtccaggttgctggactacaccgggggcacggtcagaggtctttaggggagggcggcggtctgagagtcctgggtgccgacctgttgggacccaaattccttgtgggaacgatgataaggagcaggtttacagatcataagtgcaaaagcgggcgagaagggaaacccaagcgggacaaggacttttggggggaggtcaaagggcacgaagttgtgcctgcagctgttaccatagtaaccgaggaccggatgtggcgatcttacggtgcgacagtcctcttctcaggccctctggcccgagagcctgttgactctgtgacacactctgaggagctggttgtggtgttttccagcgagggaagaaaagagtaattttttcaaagcatttatagaaacgcagcaaagggaaggtgtgaggttgccgccatgcctggcagagacggagggaggcagttggctccggaatgcggccgccgcagatgttctccgcaaccttccggaagtggaatggcgggagcctcagcattgctgcccaccgaccccccggaagcggaaacagaatccccgcgtgccccttcctcactaccctccaaatcccgctgcagccattgccgcagacacgatgccgaaacgaaagaagcagaatcatcaccagccaccgacacagcagcagcccccgctgcccgagcgggaagagactggagatgaggaggatgggagtcccatcgctcttcacagaggtcctccaggatcaaggggaccactgattccaccactgctgagtctcccacctcctccttggggtagaggcccaattcggagagggcttggccccaggtctagcccatatggtcgtggttggtggggagtcaatgcagaacctccttttccggggccaggccatgggggtcccaccaggggaagctttcacaaggaacagagaaaccctcgaaggctcaaaagctggtctcttatcaagaatacctgcccgcccaaggatgacccccaggttatggaagacaaatccgaccgccctgtctgccgacattttgccaaaaagggccactgtcgatatgaggacctctgtgccttctaccacccaggcgtcaatggacctcctctgtgagactgtgccttcccatccaggctggaaggagctctctgtgacctagcggccatttatttctctgtagccctatgatggctactgtgaggctcttctaacaccctcagtcagtgacacacccatcccatccaccacttcccccgtgtggggtccagagtggtgttgcatcactggtgcgcggcatacgcgctttcttctgatccagcctgtagagactcgccttcgggacccatctttgcttcctttcagttgcctcctggatcttctttcccgtcatcaaatgactgctgaacaggaaacctctttggtgctgtttcttgtgcatctgtccacctgttccccagtattgccctcaattcctgagagccctggagcggtttcctaccattcccttcttttagctgcttgttttaagtcctttttatgtgacattccctacccccaatgttgtcagctgcttgtgaaactcagccaggttgtctaacctggggtcaagtttgggtgactggtgcagagttacttcctaaaaggccactctccctgcctttggatttcatagtttctctgtcagtagcatgatccccaccgctatggtctatctatgatcaccgtgctttgtgaaactgtgcatccccttgtagcctttctcagtgtccgtggcatttttgtgacttcccagcactagaataagttttcctgccaaaatgagtgaggcgcttggtgccctctggactttcccacttcccaacatgggagaattgtgaactttccatcagactgcctccctggccctccccattcttctcctgttggttattctgagtctgacacagacccatgacatgtcttataaagcctccaatggctttatcctacctagatcccttccagcccattttaattagactatgtcattgtgaggccaccagtccattcatttgaattctgtgaatctccaccttgcctatctttgggtagaagctggacagtactgttgccctcttccaatcctcttcccctacatccctggcactggttgttttctgtgaaaacagcagtgaacaggttcagttttgaactggccctgaggaaatgggtcaggagttgtattggcaagagggaggggtgagagctgttggagaactgagaatgaggttttttttttttttttctttttaactttttttgtttttgttttttttttttttttttttggttttttttttttttgtgttttctgtgttttgtaaaatt

SEQ ID NO: 369638 - DNA, 1930 bp, Homo sapiens
ggcggggcctactacctaggggagagggggcgtggacacgctgaggctatactacaaagccccgggcttgaccttagtggaaagccgagactgcgtccaggttgctggactacaccgggggcacggtcagaggtctttaggggagggcggcggtctgagagtcctgggtgccgacctgttgggacccaaattccttgtgggaacgatgataaggagcaggtttacagatcataagtgcaaaagcgggcgagaagggaaacccaagcgggacaaggacttttggggggaggtcaaagggcacgaagttgtgcctgcagctgttaccatagtaaccgaggaccggatgtggcgatcttacggtgcgacagtcctcttctcaggccctctggcccgagagcctgttgactctgtgacacactctgaggagctggttgtggtgttttccagcgagggaagaaaagagtaattttttcaaagcatttatagaaacgcagcaaagggaaggtgtgaggttgccgccatgcctggcagagacggagggaggcagttggctccggaatgcggccgccgcagatgttctccgcaaccttccggaagtggaatggcgggagcctcagcattgctgcccaccgaccccccggaagcggaaacagaatccccgcgtgccccttcctcactaccctccaaatcccgctgcagccattgccgcagacacgatgccgaaacgaaagaagcagaatcatcaccagccaccgacacagcagcagcccccgctgcccgagcgggaagagactggagatgaggaggatgggagtcccatcgctcttcacagaggtcctccaggatcaaggggaccactgattccaccactgctgagtctcccacctcctccttggggtagaggcccaattcggagagggcttggccccaggtctagcccatatggtcgtggttggtggggagtcaatgcagaacctccttttccggggccaggccatgggggtcccaccaggggaagctttcacaaggaacagagaaaccctcgaaggctcaaaagctggtctcttatcaagaatacctgcccgcccaaggatgacccccaggttatggaagacaaatccgaccgccctgtctgccgacattttgccaaaaagggccactgtcgatatgaggacctctgtgccttctaccacccaggcgtcaatggacctcctctgtgagactgtgccttcccatccaggctggaaggagctctctgtgacctagcggccatttatttctctgtagccctatgatggctactgtgaggctcttctaacaccctcagtcagtgacacacccatcccatccaccacttcccccgtgtggggtccagagtggtgttgcatcactggtgcgcggcatacgcgctttcttctgatccagcctgtagagactcgccttcgggacccatctttgcttcctttcagttgcctcctggatcttctttcccgtcatcaaatgactgctgaacaggaaacctctttggtgctgtttcttgtgcatctgtccacctgttccccagtattgccctcaattcctgagagccctggagcggtttcctaccattcccttcttttagctgcttgttttaagtcctttttatgtgacattccctacccccaatgttgtcagctgcttgtgaaactcagccaggttgtctaacctggggtcaagtttgggtgactggtgcagagttacttcctaaaaggccactctccctgcctacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaaaaaaaa

SEQ ID NO: 369639 - DNA, 2691 bp, Homo sapiens
ggcggggcctactacctaggggagagggggcgtggacacgctgaggctatactacaaagccccgggcttgaccttagtggaaagccgagactgcgtccaggttgctggactacaccgggggcacggtcagaggtctttaggggagggcggcggtctgagagtcctgggtgccgacctgttgggacccaaattccttgtgggaacgatgataaggagcaggtttacagatcataagtgcaaaagcgggcgagaagggaaacccaagcgggacaaggacttttggggggaggtcaaagggcacgaagttgtgcctgcagctgttaccatagtaaccgaggaccggatgtggcgatcttacggtgcgacagtcctcttctcaggccctctggcccgagagcctgttgactctgtgacacactctgaggagctggttgtggtgttttccagcgagggaagaaaagagtaattttttcaaagcatttatagaaacgcagcaaagggaaggtgtgaggttgccgccatgcctggcagagacggagggaggcagttggctccggaatgcggccgccgcagatgttctccgcaaccttccggaagtggaatggcgggagcctcagcattgctgcccaccgaccccccggaagcggaaacagaatccccgcgtgccccttcctcactaccctccaaatcccgctgcagccattgccgcagacacgatgccgaaacgaaagaagcagaatcatcaccagccaccgacacagcagcagcccccgctgcccgagcgggaagagactggagatgaggaggatgggagtcccatcggaccacccagccttctgggccctccccccatggccaatggaaaacctggcgaccctaagtcagccccaaactggataccacccacatgtccatcatcagtagaatggataaataaattgttgtgtatgcatgcaatgggactacactgcaacgaaaatgaatgaactgctgctacaggcaacctggatgaatctcacaaacatgatgttgagcgaaaggagccagacataaaagaatgcagactctcttcacagaggtcctccaggatcaaggggaccactgattccaccactgctgagtctcccacctcctccttggggtagaggcccaattcggagagggcttggccccaggtctagcccatatggtcgtggttggtggggagtcaatgcagaacctccttttccggggccaggccatgggggtcccaccaggggaagctttcacaaggaacagagaaaccctcgaaggctcaaaagctggtctcttatcaagaatacctgcccgcccaaggatgacccccaggttatggaagacaaatccgaccgccctgtctgccgacattttgccaaaaagggccactgtcgatatgaggacctctgtgccttctaccacccaggcgtcaatggacctcctctgtgagactgtgccttcccatccaggctggaaggagctctctgtgacctagcggccatttatttctctgtagccctatgatggctactgtgaggctcttctaacaccctcagtcagtgacacacccatcccatccaccacttcccccgtgtggggtccagagtggtgttgcatcactggtgcgcggcatacgcgctttcttctgatccagcctgtagagactcgccttcgggacccatctttgcttcctttcagttgcctcctggatcttctttcccgtcatcaaatgactgctgaacaggaaacctctttggtgctgtttcttgtgcatctgtccacctgttccccagtattgccctcaattcctgagagccctggagcggtttcctaccattcccttcttttagctgcttgttttaagtcctttttatgtgacattccctacccccaatgttgtcagctgcttgtgaaactcagccaggttgtctaacctggggtcaagtttgggtgactggtgcagagttacttcctaaaaggccactctccctgcctttggatttcatagtttctctgtcagtagcatgatccccaccgctatggtctatctatgatcaccgtgctttgtgaaactgtgcatccccttgtagcctttctcagtgtccgtggcatttttgtgacttcccagcactagaataagttttcctgccaaaatgagtgaggcgcttggtgccctctggactttcccacttcccaacatgggagaattgtgaactttccatcagactgcctccctggccctccccattcttctcctgttggttattctgagtctgacacagacccatgacatgtcttataaagcctccaatggctttatcctacctagatcccttccagcccattttaattagactatgtcattgtgaggccaccagtccattcatttgaattctgtgaatctccaccttgcctatctttgggtagaagctggacagtactgttgccctcttccaatcctcttcccctacatccctggcactggttgttttctgtgaaaacagcagtgaacaggttcagttttgaactggccctgaggaaatgggtcaggagttgtattggcaagagggaggggtgagagctgttggagaactgagaatgaggttttttttttttttttctttttaactttttttatattagtaataaatgcagtggaaaccagcattttattta

SEQ ID NO: 369640 - DNA, 2339 bp, Homo sapiens
agatgagattggcatgggccaaccttaacgtggccccaccttaatgtcggtcccatgccgattgtaactattatgagtcctagttgacttgaagtggagaaggctacgaatttttttgatgtcattttgtgtaaggggcccagaactgctgcgaacagagtgggtgatagcgcctaagcatagtgttagagtttggattagtgggctattttctgctagggggtggaagcggatgagtaagaagattcctgctacaactatagtgcttgagtggagtagggctgagactgggatggggcctacttaatgttggtcccttcctcactaccctccaaatcccgctgcagccattgccgcagacacgatgccgaaacgaaagaagcagaatcatcaccagccaccgacacagcagcagcccccgctgcccgagcgggaagagactggagatgaggaggatgggagtcccatcggaccacccagccttctgggccctccccccatggccaatggaaaacctggcgaccctaagtcagccccaaactggataccacccacatgtccatcatcagtagaatggataaataaattgttgtgtatgcatgcaatgggactacactgcaacgaaaatgaatgaactgctgctacaggcaacctggatgaatctcacaaacatgatgttgagcgaaaggagccagacataaaagaatgcagactctcttcacagaggtcctccaggatcaaggggaccactgattccaccactgctgagtctcccacctcctccttggggtagaggcccaattcggagagggcttggccccaggtctagcccatatggtcgtggttggtggggagtcaatgcagaacctccttttccggggccaggccatgggggtcccaccaggggaagctttcacaaggaacagagaaaccctcgaaggctcaaaagctggtctcttatcaagaatacctgcccgcccaaggatgacccccaggttatggaagacaaatccgaccgccctgtctgccgacattttgccaaaaagggccactgtcgatatgaggacctctgtgccttctaccacccaggcgtcaatggacctcctctgtgagactgtgccttcccatccaggctggaaggagctctctgtgacctagcggccatttatttctctgtagccctatgatggctactgtgaggctcttctaacaccctcagtcagtgacacacccatcccatccaccacttcccccgtgtggggtccagagtggtgttgcatcactggtgcgcggcatacgcgctttcttctgatccagcctgtagagactcgccttcgggacccatctttgcttcctttcagttgcctcctggatcttctttcccgtcatcaaatgactgctgaacaggaaacctctttggtgctgtttcttgtgcatctgtccacctgttccccagtattgccctcaattcctgagagccctggagcggtttcctaccattcccttcttttagctgcttgttttaagtcctttttatgtgacattccctacccccaatgttgtcagctgcttgtgaaactcagccaggttgtctaacctggggtcaagtttgggtgactggtgcagagttacttcctaaaaggccactctccctgcctttggatttcatagtttctctgtcagtagcatgatccccaccgctatggtctatctatgatcaccgtgctttgtgaaactgtgcatccccttgtagcctttctcagtgtccgtggcatttttgtgacttcccagcactagaataagttttcctgccaaaatgagtgaggcgcttggtgccctctggactttcccacttcccaacatgggagaattgtgaactttccatcagactgcctccctggccctccccattcttctcctgttggttattctgagtctgacacagacccatgacatgtcttataaagcctccaatggctttatcctacctagatcccttccagcccattttaattagactatgtcattgtgaggccaccagtccattcatttgaattctgtgaatctccaccttgcctatctttgggtagaagctggacagtactgttgccctcttccaatcctcttcccctacatccctggcactggttgttttctgtgaaaacagcagtgaacaggttcagttttgaactggccctgaggaaatgggtcaggagttgtattggcaagagggaggggtgagagctgttggagaactgagaatgaggttttttttttttttttctttttaactttttttatattagtaataaatgcagtggaaaccagcattttattta

SEQ ID NO: 369641 - DNA, 1337 bp, Homo sapiens
ggcggggcctactacctaggggagagggggcgtggacacgctgaggctatactacaaagccccgggcttgaccttagtggaaagccgagactgcgtccaggttgctggactacaccgggggcacggtcagaggtctttaggggagggcggcggtctgagagtcctgggtgccgacctgttgggacccaaattccttgtgggaacgatgataaggagcaggtttacagatcataagtgcaaaagcgggcgagaagggaaacccaagcgggacaaggacttttggggggaggtcaaagggcacgaagttgtgcctgcagctgttaccatagtaaccgaggaccggatgtggcgatcttacggtgcgacagtcctcttctcaggccctctggcccgagagcctgttgactctgtgacacactctgaggagctggttgtggtgttttccagcgagggaagaaaagagtaattttttcaaagcatttatagaaacgcagcaaagggaaggtgtgaggttgccgccatgcctggcagagacggagggaggcagttggctccggaatgcggccgccgcagatgttctccgcaaccttccggaagtggaatggcgggagcctcagcattgctgcccaccgaccccccggaagcggaaacagaatccccgcgtgccccttcctcactaccctccaaatcccgctgcagccattgccgcagacacgatgccgaaacgaaagaagcagaatcatcaccagccaccgacacagcagcagcccccgctgcccgagcgggaagagactggagatgaggaggatgggagtcccatcggaccacccagccttctgggccctccccccatggccaatggaaaacctggcgaccctaagtcagccccaaactggataccacccacatgtccatcatcagtagaatggataaataaattgttgtgtatgcatgcaatgggactacactgcaacgaaaatgaatgaactgctgctacaggcaacctggatgaatctcacaaacatgatgttgagcgaaaggagccagacataaaagaatgcagactgtatgattccatttttgtgaagttcaaaaacaggcaaaaactaacctatggtgtcaggatagtggttacctttggggaggagggtgggtaatgggaaaaggggcacaaggggaggatcttttgaggtgctaataaggctttatctcttcacctggtggtggaaactcaagtgtgtctactttgtgagaactgggttgtgcacttaaaactggtgtgtctttatgtatgctgttcttcaataaaaaaaatttttttaatcacggttatcagg

SEQ ID NO: 369642 - DNA, 1715 bp, Homo sapiens
ggcggggcctactacctaggggagagggggcgtggacacgctgaggctatactacaaagccccgggcttgaccttagtggaaagccgagactgcgtccaggttgctggactacaccgggggcacggtcagaggtctttaggggagggcggcggtctgagagtcctgggtgccgacctgttgggacccaaattccttgtgggaacgatgataaggagcaggtttacagatcataagtgcaaaagcgggcgagaagggaaacccaagcgggacaaggacttttggggggaggtcaaagggcacgaagttgtgcctgcagctgttaccatagtaaccgaggaccggatgtggcgatcttacggtgcgacagtcctcttctcaggccctctggcccgagagcctgttgactctgtgacacactctgaggagctggttgtggtgttttccagcgagggaagaaaagagtaattttttcaaagcatttatagaaacgcagcaaagggaaggtgtgaggttgccgccatgcctggcagagacggagggaggcagttggctccggaatgcggccgccgcagatgttctccgcaaccttccggaagtggaatggcgggagcctcagcattgctgcccaccgaccccccggaagcggaaacagaatccccgcgtgccccttcctcactaccctccaaatcccgctgcagccattgccgcagacacgatgccgaaacgaaagaagcagaatcatcaccagccaccgacacagcagcagcccccgctgcccgagcgggaagagactggagatgaggaggatgggagtcccatcggaccacccagccttctgggccctccccccatggccaatggaaaacctggcgaccctaagtcaggtgaggaggaaggggccctgatccttgtattaggtcgtagagaagacagcaagggaggggataaaacccaggaaggacttaaaaataaaagatcagggattccatccctaaatgaatggagagaagttgtatatttgctgatttaaaaactcaatgttgtaaaaatgtcacttcttcccaaattgataaacagatttcatgcattccaagtcagaacacccataatgtttttgtggaaatacacattattatagggaaatgcaaaatatcaaggcgactatcaagacaatcttgaagtgggagggcttactatgaatatcaagatttgtaagctgggcatggtggcacacgcctgtagtcccagttactcaggaggctgaggtgcgaggatcctttgagcccaggagtttttgaggccactctgggcaacatagtgagatcctgtctctaaatacaagaagaaaaaaaagacttactataaagctacaatagttacaacgatgcagtttggaaacaatgatagacataagtcaataggacttatgtcccgaagagtccaataacaggcccatacatgtgtggacacttcatttatgatgaagatggaactgaaaagttggtcttttcaataaatgatattggatcaattggatattcatgtgaaaaaaatggaatttcaccttgcactcataatcatatacaaagatctatttcaaatggactgtagatctaagtataaaaggtaagagaataattattctagaaagtaaatgtattttctaagagtagctaagagttcttaaacagacaagaaatgcacgtatacacac

SEQ ID NO: 369643 - DNA, 1237 bp, Homo sapiens
ggcggggcctactacctaggggagagggggcgtggacacgctgaggctatactacaaagccccgggcttgaccttagtggaaagccgagactgcgtccaggttgctggactacaccgggggcacggtcagaggtctttaggggagggcggcggtctgagagtcctgggtgccgacctgttgggacccaaattccttgtgggaacgatgataaggagcaggtttacagatcataagtgcaaaagcgggcgagaagggaaacccaagcgggacaaggacttttggggggaggtcaaagggcacgaagttgtgcctgcagctgttaccatagtaaccgaggaccggatgtggcgatcttacggtgcgacagtcctcttctcaggccctctggcccgagagcctgttgactctgtgacacactctgaggagctggttgtggtgttttccagcgagggaagaaaagagtaattttttcaaagcatttatagaaacgcagcaaagggaaggtgtgaggttgccgccatgcctggcagagacggagggaggcagttggctccggaatgcggccgccgcagatgttctccgcaaccttccggaagtggaatggcgggagcctcagcattgctgcccaccgaccccccggaagcggaaacagaatccccgcgtgccccttcctcactaccctccaaatcccgctgcagccattgccgcagacacgatgccgaaacgaaagaagcagaatcatcaccagccaccgacacagcagcagcccccgctgcccgagcgggaagagactggagatgaggaggatgggagtcccatcggaccacccagccttctgggccctccccccatggccaatggaaaacctggcgaccctaagtcagccccaaactggataccacccacatgtccatcatcagtagaatggataaataaattgttgtgtatgcatgcaatgggactacactgcaacgaaaatgaatgaactgctgctacaggcaaaaactaacctatggtgtcaggatagtggttacctttggggaggagggtgggtaatgggaaaaggggcacaaggggaggatcttttgaggtgctaataaggctttatctcttcacctggtggtggaaactcaagtgtgtctactttgtgagaactgggttgtgcacttaaaactggtgtgtctttatgtatgctgttcttcaataaaaaaaatttttttaatcacggttatcagg

SEQ ID NO: 369644 - DNA, 2974 bp, Homo sapiens
ggcggggcctactacctaggggagagggggcgtggacacgctgaggctatactacaaagccccgggcttgaccttagtggaaagccgagactgcgtccaggttgctggactacaccgggggcacggtcagaggtctttaggggagggcggcggtctgagagtcctgggtgccgacctgttgggacccaaattccttgtgggaacgatgataaggagcaggtttacagatcataagtgcaaaagcgggcgagaagggaaacccaagcgggacaaggacttttggggggaggtcaaagggcacgaagttgtgcctgcagctgttaccatagtaaccgaggaccggatgtggcgatcttacggtgcgacagtcctcttctcaggccctctggcccgagagcctgttgactctgtgacacactctgaggagctggttgtggtgttttccagcgagggaagaaaagagtaattttttcaaagcatttatagaaacgcagcaaagggaaggtgtgaggttgccgccatgcctggcagagacggagggaggcagttggctccggaatgcggccgccgcagatgttctccgcaaccttccggaagtggaatggcgggagcctcagcattgctgcccaccgaccccccggaagcggaaacagaatccccgcgtgccccttcctcactaccctccaaatcccgctgcagccattgccgcagacacgatgccgaaacgaaagaagcagaatcatcaccagccaccgacacagcagcagcccccgctgcccgagcgggaagagactggagatgaggaggatgggagtcccatcggaccacccagccttctgggccctccccccatggccaatggaaaacctggcgaccctaagtcagctcttcacagaggtcctccaggatcaaggggaccactgattccaccactgctgagtctcccacctcctccttggggtagaggcccaattcggagagggcttggccccaggtctagcccatatggtcgtggttggtggggagtcaatgcagaacctccttttccggggccaggccatgggggtcccaccaggggaagctttcacaaggaacagagaaaccctcgaaggctcaaaagctggtctcttatcaagaatacctgcccgcccaaggatgacccccaggttatggaagacaaatccgaccgccctgtctgccgacattttgccaaaaagggccactgtcgatatgaggacctctgtgccttctaccacccaggcgtcaatggacctcctctgtgagactgtgccttcccatccaggctggaaggagctctctgtgacctagcggccatttatttctctgtagccctatgatggctactgtgaggctcttctaacaccctcagtcagtgacacacccatcccatccaccacttcccccgtgtggggtccagagtggtgttgcatcactggtgcgcggcatacgcgctttcttctgatccagcctgtagagactcgccttcgggacccatctttgcttcctttcagttgcctcctggatcttctttcccgtcatcaaatgactgctgaacaggaaacctctttggtgctgtttcttgtgcatctgtccacctgttccccagtattgccctcaattcctgagagccctggagcggtttcctaccattcccttcttttagctgcttgttttaagtcctttttatgtgacattccctacccccaatgttgtcagctgcttgtgaaactcagccaggttgtctaacctggggtcaagtttgggtgactggtgcagagttacttcctaaaaggccactctccctgcctttggatttcatagtttctctgtcagtagcatgatccccaccgctatggtctatctatgatcaccgtgctttgtgaaactgtgcatccccttgtagcctttctcagtgtccgtggcatttttgtgacttcccagcactagaataagttttcctgccaaaatgagtgaggcgcttggtgccctctggactttcccacttcccaacatgggagaattgtgaactttccatcagactgcctccctggccctccccattcttctcctgttggttattctgagtctgacacagacccatgacatgtcttataaagcctccaatggctttatcctacctagatcccttccagcccattttaattagactatgtcattgtgaggccaccagtccattcatttgaattctgtgaatctccaccttgcctatctttgggtagaagctggacagtactgttgccctcttccaatcctcttcccctacatccctggcactggttgttttctgtgaaaacagcagtgaacaggttcagttttgaactggccctgaggaaatgggtcaggagttgtattggcaagagggaggggtgagagctgttggagaactgagaatgaggttttttttttttttttctttttaactttttttatattagtaataaatgcagtggaaaccagcattttatttaatccctgtgttctagtcatctctggagttgcagatgaagctgttctcacctggtggagtcagcttattctttagttcatacacactagtgatggggaatgacaaagcttaaggttcttccaggctgaaaaaaaccaatggaggttccattagcctgtaggcatcaaccagaacaagctgccttatgttcaagggcaaagttttgtaagaaaaaggaaaggccaggtgtccgtggagttatttttaaatattttactttgcagagtttgtgtttatggagtggtaatgatgaaggagtctttcagcagcaatttgcagaatgcctgtgggccaggcaatataccaagcactagagataactgacagccaaagccaatggatttaaaatgtacagggaagacaggtttctcataatcacaaatagcatgtaaagttaaacctgtcaaaagtgctgggaagaagaca

SEQ ID NO: 369645 - DNA, 2447 bp, Homo sapiens
ggcggggcctactacctaggggagagggggcgtggacacgctgaggctatactacaaagccccgggcttgaccttagtggaaagccgagactgcgtccaggttgctggactacaccgggggcacggtcagaggtctttaggggagggcggcggtctgagagtcctgggtgccgacctgttgggacccaaattccttgtgggaacgatgataaggagcaggtttacagatcataagtgcaaaagcgggcgagaagggaaacccaagcgggacaaggacttttggggggaggtcaaagggcacgaagttgtgcctgcagctgttaccatagtaaccgaggaccggatgtggcgatcttacggtgcgacagtcctcttctcaggccctctggcccgagagcctgttgactctgtgacacactctgaggagctggttgtggtgttttccagcgagggaagaaaagagtaattttttcaaagcatttatagaaacgcagcaaagggaaggtgtgaggttgccgccatgcctggcagagacggagggaggcagttggctccggaatgcggccgccgcagatgttctccgcaaccttccggaagtggaatggcgggagcctcagcattgctgcccaccgaccccccggaagcggaaacagaatccccgcgtgccccttcctcactaccctccaaatcccgctgcagccattgccgcagacacgatgccgaaacgaaagaagcagaatcatcaccagccaccgacacagcagcagcccccgctgcccgagcgggaagagactggagatgaggaggatgggagtcccatcgctcttcacagaggtcctccaggatcaaggggaccactgattccaccactgctgagtctcccacctcctccttggggtagaggcccaattcggagagggcttggccccaggtctagcccatatggtcgtggttggtggggagtcaatgcagaacctccttttccggggccaggccatgggggtcccaccaggggaagctttcacaaggaacagagaaaccctcgaaggctcaaaagctggtctcttatcaagaatacctgcccgcccaaggatgacccccaggttatggaagacaaatccgaccgccctgtctgccgacattttgccaaaaagggccactgtcgatatgaggacctctgtgccttctaccacccaggcgtcaatggacctcctctgtgagactgtgccttcccatccaggctggaaggagctctctgtgacctagcggccatttatttctctgtagccctatgatggctactgtgaggctcttctaacaccctcagtcagtgacacacccatcccatccaccacttcccccgtgtggggtccagagtggtgttgcatcactggtgcgcggcatacgcgctttcttctgatccagcctgtagagactcgccttcgggacccatctttgcttcctttcagttgcctcctggatcttctttcccgtcatcaaatgactgctgaacaggaaacctctttggtgctgtttcttgtgcatctgtccacctgttccccagtattgccctcaattcctgagagccctggagcggtttcctaccattcccttcttttagctgcttgttttaagtcctttttatgtgacattccctacccccaatgttgtcagctgcttgtgaaactcagccaggttgtctaacctggggtcaagtttgggtgactggtgcagagttacttcctaaaaggccactctccctgcctttggatttcatagtttctctgtcagtagcatgatccccaccgctatggtctatctatgatcaccgtgctttgtgaaactgtgcatccccttgtagcctttctcagtgtccgtggcatttttgtgacttcccagcactagaataagttttcctgccaaaatgagtgaggcgcttggtgccctctggactttcccacttcccaacatgggagaattgtgaactttccatcagactgcctccctggccctccccattcttctcctgttggttattctgagtctgacacagacccatgacatgtcttataaagcctccaatggctttatcctacctagatcccttccagcccattttaattagactatgtcattgtgaggccaccagtccattcatttgaattctgtgaatctccaccttgcctatctttgggtagaagctggacagtactgttgccctcttccaatcctcttcccctacatccctggcactggttgttttctgtgaaaacagcagtgaacaggttcagttttgaactggccctgaggaaatgggtcaggagttgtattggcaagagggaggggtgagagctgttggagaactgagaatgaggttttttttttttttttctttttaactttttttatattagtaataaatgcagtggaaaccagcattttattta

SEQ ID NO: 369646 - DNA, 2628 bp, Homo sapiens
ggcggggcctactacctaggggagagggggcgtggacacgctgaggctatactacaaagccccgggcttgaccttagtggaaagccgagactgcgtccaggttgctggactacaccgggggcacggtcagaggtctttaggggagggcggcggtctgagagtcctgggtgccgacctgttgggacccaaattccttgtgggaacgatgataaggagcaggtttacagatcataagtgcaaaagcgggcgagaagggaaacccaagcgggacaaggacttttggggggaggtcaaagggcacgaagttgtgcctgcagctgttaccatagtaaccgaggaccggatgtggcgatcttacggtgcgacagtcctcttctcaggccctctggcccgagagcctgttgactctgtgacacactctgaggagctggttgtggtgttttccagcgagggaagaaaagagtaattttttcaaagcatttatagaaacgcagcaaagggaaggtgtgaggttgccgccatgcctggcagagacggagggaggcagttggctccggaatgcggccgccgcagatgttctccgcaaccttccggaagtggaatggcgggagcctcagcattgctgcccaccgaccccccggaagcggaaacagaatccccgcgtgccccttcctcactaccctccaaatcccgctgcagccattgccgcagacacgatgccgaaacgaaagaagcagaatcatcaccagccaccgacacagcagcagcccccgctgcccgagcgggaagagactggagatgaggaggatgggagtcccatcgccccaaactggataccacccacatgtccatcatcagtagaatggataaataaattgttgtgtatgcatgcaatgggactacactgcaacgaaaatgaatgaactgctgctacaggcaacctggatgaatctcacaaacatgatgttgagcgaaaggagccagacataaaagaatgcagactctcttcacagaggtcctccaggatcaaggggaccactgattccaccactgctgagtctcccacctcctccttggggtagaggcccaattcggagagggcttggccccaggtctagcccatatggtcgtggttggtggggagtcaatgcagaacctccttttccggggccaggccatgggggtcccaccaggggaagctttcacaaggaacagagaaaccctcgaaggctcaaaagctggtctcttatcaagaatacctgcccgcccaaggatgacccccaggttatggaagacaaatccgaccgccctgtctgccgacattttgccaaaaagggccactgtcgatatgaggacctctgtgccttctaccacccaggcgtcaatggacctcctctgtgagactgtgccttcccatccaggctggaaggagctctctgtgacctagcggccatttatttctctgtagccctatgatggctactgtgaggctcttctaacaccctcagtcagtgacacacccatcccatccaccacttcccccgtgtggggtccagagtggtgttgcatcactggtgcgcggcatacgcgctttcttctgatccagcctgtagagactcgccttcgggacccatctttgcttcctttcagttgcctcctggatcttctttcccgtcatcaaatgactgctgaacaggaaacctctttggtgctgtttcttgtgcatctgtccacctgttccccagtattgccctcaattcctgagagccctggagcggtttcctaccattcccttcttttagctgcttgttttaagtcctttttatgtgacattccctacccccaatgttgtcagctgcttgtgaaactcagccaggttgtctaacctggggtcaagtttgggtgactggtgcagagttacttcctaaaaggccactctccctgcctttggatttcatagtttctctgtcagtagcatgatccccaccgctatggtctatctatgatcaccgtgctttgtgaaactgtgcatccccttgtagcctttctcagtgtccgtggcatttttgtgacttcccagcactagaataagttttcctgccaaaatgagtgaggcgcttggtgccctctggactttcccacttcccaacatgggagaattgtgaactttccatcagactgcctccctggccctccccattcttctcctgttggttattctgagtctgacacagacccatgacatgtcttataaagcctccaatggctttatcctacctagatcccttccagcccattttaattagactatgtcattgtgaggccaccagtccattcatttgaattctgtgaatctccaccttgcctatctttgggtagaagctggacagtactgttgccctcttccaatcctcttcccctacatccctggcactggttgttttctgtgaaaacagcagtgaacaggttcagttttgaactggccctgaggaaatgggtcaggagttgtattggcaagagggaggggtgagagctgttggagaactgagaatgaggttttttttttttttttctttttaactttttttatattagtaataaatgcagtggaaaccagcattttattta

SEQ ID NO: 369647 - DNA, 1910 bp, Homo sapiens
taacagtattataagatagaattttttgcaggatgcgataggataggcccattaatgaggatctgctcagcaacaacgaagtcagtaatcatcgtatcactgattgcctgaatactgagagatagtcgtaatcgtaacagctagtcaccgacatctaagcaagctaacccccgctgcccgagcgggaagagactggagatgaggaggatgggagtcccatcggaccacccagccttctgggccctccccccatggccaatggaaaacctggcgaccctaagtcagctcttcacagaggtcctccaggatcaaggggaccactgattccaccactgctgagtctcccacctcctccttggggtagaggcccaattcggagagggcttggccccaggtctagcccatatggtcgtggttggtggggagtcaatgcagaacctccttttccggggccaggccatgggggtcccaccaggggaagctttcacaaggaacagagaaaccctcgaaggctcaaaagctggtctcttatcaagaatacctgcccgcccaaggatgacccccaggttatggaagacaaatccgaccgccctgtctgccgacattttgccaaaaagggccactgtcgatatgaggacctctgtgccttctaccacccaggcgtcaatggacctcctctgtgagactgtgccttcccatccaggctggaaggagctctctgtgacctagcggccatttatttctctgtagccctatgatggctactgtgaggctcttctaacaccctcagtcagtgacacacccatcccatccaccacttcccccgtgtggggtccagagtggtgttgcatcactggtgcgcggcatacgcgctttcttctgatccagcctgtagagactcgccttcgggacccatctttgcttcctttcagttgcctcctggatcttctttcccgtcatcaaatgactgctgaacaggaaacctctttggtgctgtttcttgtgcatctgtccacctgttccccagtattgccctcaattcctgagagccctggagcggtttcctaccattcccttcttttagctgcttgttttaagtcctttttatgtgacattccctacccccaatgttgtcagctgcttgtgaaactcagccaggttgtctaacctggggtcaagtttgggtgactggtgcagagttacttcctaaaaggccactctccctgcctttggatttcatagtttctctgtcagtagcatgatccccaccgctatggtctatctatgatcaccgtgctttgtgaaactgtgcatccccttgtagcctttctcagtgtccgtggcatttttgtgacttcccagcactagaataagttttcctgccaaaatgagtgaggcgcttggtgccctctggactttcccacttcccaacatgggagaattgtgaactttccatcagactgcctccctggccctccccattcttctcctgttggttattctgagtctgacacagacccatgacatgtcttataaagcctccaatggctttatcctacctagatcccttccagcccattttaattagactatgtcattgtgaggccaccagtccattcatttgaattctgtgaatctccaccttgcctatctttgggtagaagctggacagtactgttgccctcttccaatcctcttcccctacatccctggcactggttgttttctgtgaaaacagcagtgaacaggttcagttttgaactggccctgaggaaatgggtcaggagttgtattggcaagagggaggggtgagagctgttggagaactgagaatgaggttttttttttttttttctttttaactttttttatattagtaataaatgcagtggaaaccagcattttattta

SEQ ID NO: 369648 - DNA, 1274 bp, Homo sapiens
ggcggggcctactacctaggggagagggggcgtggacacgctgaggctatactacaaagccccgggcttgaccttagtggaaagccgagactgcgtccaggttgctggactacaccgggggcacggtcagaggtctttaggggagggcggcggtctgagagtcctgggtgccgacctgttgggacccaaattccttgtgggaacgatgataaggagcaggtttacagatcataagtgcaaaagcgggcgagaagggaaacccaagcgggacaaggacttttggggggaggtcaaagggcacgaagttgtgcctgcagctgttaccatagtaaccgaggaccggatgtggcgatcttacggtgcgacagtcctcttctcaggccctctggcccgagagcctgttgactctgtgacacactctgaggagctggttgtggtgttttccagcgagggaagaaaagagtaattttttcaaagcatttatagaaacgcagcaaagggaaggtgtgaggttgccgccatgcctggcagagacggagggaggcagttggctccggaatgcggccgccgcagatgttctccgcaaccttccggaagtggaatggcgggagcctcagcattgctgcccaccgaccccccggaagcggaaacagaatccccgcgtgccccttcctcactaccctccaaatcccgctgcagccattgccgcagacacgatgccgaaacgaaagaagcagaatcatcaccagccaccgacacagcagcagcccccgctgcccgagcgggaagagactggagatgaggaggatgggagtcccatcgccccaaactggataccacccacatgtccatcatcagtagaatggataaataaattgttgtgtatgcatgcaatgggactacactgcaacgaaaatgaatgaactgctgctacaggcaacctggatgaatctcacaaacatgatgttgagcgaaaggagccagacataaaagaatgcagactgtatgattccatttttgtgaagttcaaaaacaggcaaaaactaacctatggtgtcaggatagtggttacctttggggaggagggtgggtaatgggaaaaggggcacaaggggaggatcttttgaggtgctaataaggctttatctcttcacctggtggtggaaactcaagtgtgtctactttgtgagaactgggttgtgcacttaaaactggtgtgtctttatgtatgctgttcttcaataaaaaaaatttttttaatcacggttatcagg

SEQ ID NO: 369649 - DNA, 366 bp, Homo sapiens
gaagcggacgccagttccagactccctaggcctagaaatggagcacaggttcattgatcaagtattgtccacctgtcggaacgtggagcaagccaggtttgccagtgcatacaggaaatggctggttactttgagtcaatgaaagaggtgaattagtcctacaaggttccccttttagtgcaatattgctttcttttattatttacatagttgcatgaactgtttactattattggctaaccatatgttcttcgtctttaggttgaaagtccatagtaaatctttcattttatttattttgttaataactggcattcctgtggggataaaataatcgtatagttccttcctgctgaacagcgagtc

SEQ ID NO: 369650 - DNA, 4532 bp, Homo sapiens
aattctcgagctcgtcgaccggtcgacgagctcgagggtcgacgagctcgagggcgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 369651 - DNA, 491 bp, Homo sapiens
ccgtcagtcgctcttgtggctgcctgcctacaactacctttctacggacgtgggatcctgcaccctcgtctgccccctgcacaaccaagaggtgacagcagaggatggaacacagcggtgtgaggagaggaagaaagaaaagcagcttcacagtcaaagatgggtttattttggagaacaagcctgagcggggcttctggctgagttaggtcaggagtgttctctcttacagactaagggtatgtaggggtttaggaaggggaatcttatcgcaggctcggaatgtttccctgtgaggcaaagttgagtgaggtgttagaatgtctctggtctgaaggaggttatcttgggcttgggatgtttctggtcagaggcggtttatgtcaggcttggagtgtttcgggtcatgctgacattagccattaggctgatgttgtggggctggttttaggcagtttttaatcacgggaacttaaaatggcaaggcttgt

SEQ ID NO: 369652 - DNA, 401 bp, Homo sapiens
tctagcctcgccagtgtcctagcctcgccagtgtcctagcctcgccagtgtcctagcctcgccagtggctgggggccttgcccaagatctccaagtactggggaaccccagggaggccctggggggtggcagtgttcctatttcagccccactctgcttccccctcccaggatatccaggaggtgcagggctacgtgctcatcgctcacaaccaagtgaggcaggtcccactgcagaggctgcggattgtgcgaggcacccagctctttgaggacaactatgccctggccgtgctagacaatggagaccaggaaagaccagaaggaagaggaggaagagagaggcaggagcaggcgtagggaagaaagaggacagaaataacaggtttcagagatgcccgc

SEQ ID NO: 369653 - DNA, 421 bp, Homo sapiens
ttagaggatccgggcgacttctctctccggggggagtggctgggaatcttcagaaagcttggatgaggagccagacatccagttctccagcttcagggttgggggagatcgggaagctggattcagatctgagagccctttgacgaccagatcattcttatttagaacgaactaattcctaaggccactcaccagaatggggttatttcctccttgtgagtgaggagagtggtgggtagggtgggggaaagacgaggcagggtctactgtgggactcattttccttgccttggctatgccagaggagctcactgacctaaggagtagctgtccagaaagcccacccagccagcacagccaccctggcggtgcaaaggctgggctgaccggacttctgtgccccccacattcccagactgga

SEQ ID NO: 369654 - DNA, 5061 bp, Homo sapiens
  misc_feature (32)..(33): n is a, c, g, or t
  misc_feature (5061)..(5061): n is a, c, g, or t
aaggggaggtaaccctggcccctttggtcggnnccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaacaaaaaaaaaaaaaaaaaaaaaaaaaaaaaaaaaaaaaaaaaaaaaaaaaaaaaaaaaaagacacacaaagaaacaaaaaacaacaaaatgcaaaaacaatagaaaaaagaaagagaaggggggcgcgggcccgaaactaaacaaatcaccaacggggaggggagcacccgaaatgcggactcccaccgacgccttttgtagaaacgaaaggggtgcccacaagaagggaagagttatatataaaaagagcgggcggggggggaccgataaaaaaaagcagggtgagggaagaaaacaacagtcgctagggatgactattatgtggaagaaacaccacaattgtggtgggggaaaaatggggaaacgacacccaccggaggaatgtatgagggggggaggaataaacaacgggagtgatggctggtcaaaccagacaatatgtgatcaggagacgaaatgacatggtaattattgtataagtagtcggggtgtgtgtatgacatgan

SEQ ID NO: 369655 - DNA, 5027 bp, Homo sapiens
  misc_feature (32)..(33): n is a, c, g, or t
aaggggaggtaaccctggcccctttggtcggnnccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaacagctaggcaccggcctatgtctgggggtggctctgtgccatcccttcctgctcaccttacactcaattcctcttttcctggagggagtggctgggaatcttcagaaagcttggatgaggagccagacatccagttctccagcttcagggttgggggagatcgggaagctggattcagatctgagagccctttgacgaccagatcattcttatttagaacgaactaattcctaaggccactcaccagaatggggttatttcctccttgtgagtgaggagagtggtgggtagggtgggggaaagacgaggcagggtctactgtgggactcattttccttgccttggctatgccagaggagctcactgacctaaggagtagctgtccagaaagcccacccagccagcacagccaccctggcggtgcaaaggctgggctgaccggacttctgtgccccccacattcccagactgga

SEQ ID NO: 369656 - DNA, 4806 bp, Homo sapiens
aattctcgagctcgtcgaccggtcgacgagctcgagggtcgacgagctcgagggcgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgaggtacccactcactgcccccgaggccagctgcagttcctgtccctctgcgcatgcagcctggcccagcccaccctgtcctatccttcctcagaccctcttgggacctagtctctgccttctactctctacccctggcccccctcagccctacaagtgtccctatatcccctgtcagtgtggggaggggcccggaccctgatgctcatgtggctgttgacctgtcccggtatgaaggctgagacggccccttccccacccacccccacctcctcagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 369657 - DNA, 4314 bp, Homo sapiens
atcagctcggtacctgtcgatctttcaactgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 369658 - DNA, 4327 bp, Homo sapiens
tctagcctcgccagtgtcctagcctcgccagtgtcctagcctcgccagtgtcctagcctcgccagtggctgggggccttgcccaagatctccaagtactggggaaccccagggaggccctggggggtggcagtgttcctatttcagccccactctgcttccccctcccaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 369659 - DNA, 4559 bp, Homo sapiens
  misc_feature (18)..(18): n is a, c, g, or t
  misc_feature (74)..(74): n is a, c, g, or t
  misc_feature (108)..(108): n is a, c, g, or t
aaacttcatcaaggtacntaaggttgtaaggttctcggggggtagcggcttgcacacctcttgaagggcttcanccgggcccctggctccttcaggctggctgccttnatccgcttatccaatgattggataacggatgaggggagtctgggtgccaggtgctttgcccgcatggcccatttcagtcacgctgcagtcctgtcaggaaaaaatcagtgttattctcattctacatatgagaaaactgaggcttgcagatataagggccaaaagttacacagctagtgagtgatggggctgagtttcagactccacagtctcttaaccaccaagcagcatgcccagagtagaggtgagaaggaaggagagagctgcggtccacatgagcatctggacctagcatggacaactcactcctccctggctctcgctttgttcttgttgcgggtgtggtggtggtgggactcaaagacggtaaagatagctttctctcctccctggggaatctgggggttgtttaaaaggcctgctcctcttttagaaggcaggagggccccaagggaagcagaaggtgacagaaggggaaagggtcctctgatcattgctcaccccacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 369660 - DNA, 4051 bp, Homo sapiens
cagggaaggaggctttgccagcctccttccctgtgcctcttcatctctggggttctctgtcttgtctccctctgcttataggttgtgcctctggtttgggggcctctcagcctgtctgggtccctcccttgctgtgcagttggcctcgtggcctctgctgctgtttgtgcctctctctgttattaacccgtcctctcgctgttagacatctctctcactgcctgtctctggttctgtcctcaggccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 369661 - DNA, 3337 bp, Homo sapiens
agcaggctggagtgcagtggtacgatcttggctcactgcaacctctgcctcctggattcaagcaattctcctgcctcagtctcctgagtagctgggactacagggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 369662 - DNA, 3320 bp, Homo sapiens
  misc_feature (41)..(41): n is a, c, g, or t
taccctgaaaattccagtggccatcaaagtgttgagggaanacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactgctggattcagacccagctcctgcttccaaccttggttttttattcctaaaatgggtattgtaataatacctaccttgctggggtgtggcaagaatgaaattaaacagggcttggcacagtgaagcacgggaaaggctttctacagagcagtgactgttgttactcgctgttacaccttaggtaatgcgttttcctctctgggtgcctcccattttctggctcaagtccctgcccaggatcaagcttggaggagggccccgagggaggggccacagagactgggtgaagagcaagggtgtttgtcccaggagcatggcgaaaattgctgctgggtggccttgggaagcacaaaggggacccaactaagggcctgatcctactgcctgggggtgtcagtgccagccccccacaaatcttttctgccccccccaggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 369663 - DNA, 2689 bp, Homo sapiens
cgagtacggtagcgaggctgggtcgccgtacgtgttttggaggggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 369664 - DNA, 5360 bp, Homo sapiens
attctactctccgctgaagtccacacagtttaaattaaagttcccggatttttgtgggcgcctgccccgcccctcgtccccctgctgtgtccatatatcgaggcgatagggttaagggaaggcggacgcctgatgggttaatgagcaaactgaagtgttttccatgatcttttttgagtcgcaattgaagtaccacctcccgagggtgattgcttccccatgcggggtagaacctttgctgtcctgttcaccactctacctccagcacagaatttggcttatgcctactcaatgtgaagatgatgaggatgaaaacctttgtgatgatccacttccacttaatgaatggttcctcgtctcctcttccttggaccaaaagtcagaggcaagaatgccctcattcataccccagtggtctatacctccagcagcaagtcgagtgagcaagtgatgtcctgaaaggcccagtggatcagtggaatgaagcgggcaggaagacttagtgctcctgaaacaaggaatccagaatccaggagaaggatggctcagtggggctttcaagggacaagtatgggggttgaaggggtcactgtccctataccaaatccgaaaatattgtgaccaggaaccattctgtccaactcttctatttcaggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgcctctgtgacaccccctgacctatggaagggaactcatgttggccggacattttaccatgtgccaggcactgcgggcactttacataaagcagccaatgtcagaactagaaagcgggagagctgggattcagagcacagactgacccagcaggtgttctgcgagcctcacctgtgcccccgaggcgcgactcgatctcgatgcccggatactgctccttcacagcactggccagctccaggtaggtcgcctcgaagccgcagggttcacagtactccaccacgatgcggaccccactgcccggctcgacctcctcgggagggggcgctacggacgtctgccccggctccccgctcatcgcggccggctccgctcgggc

SEQ ID NO: 369665 - DNA, 1907 bp, Homo sapiens
gggtgcttcccattccaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 369666 - DNA, 1814 bp, Homo sapiens
ccccagagtctggtgctacttctctaccacctgagggctttgggctgtcccttgggactgtctagaccagactggagggggagtgggaggggagaggcagcaagcacacagggcctgggactagcatgctgacctccctcctgccccaggttggatgattgactctgaatgtcggccaagattccgggagttggtgtctgaattctcccgcatggccagggacccccagcgctttgtggtcatccaggtactgggcctctgtgccccatccctgcctgtggctaagagcaccctcctgcagagggtgggaaggagagatgagtccagtatgccaggcccctcacggaaggctgcatgctgggctggggaggggccaccatcctgcctctccttcctccacagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 369667 - DNA, 4210 bp, Homo sapiens
attctactctccgctgaagtccacacagtttaaattaaagttcccggatttttgtgggcgcctgccccgcccctcgtccccctgctgtgtccatatatcgaggcgatagggttaagggaaggcggacgcctgatgggttaatgagcaaactgaagtgttttccatgatcttttttgagtcgcaattgaagtaccacctcccgagggtgattgcttccccatgcggggtagaacctttgctgtcctgttcaccactctacctccagcacagaatttggcttatgcctactcaatgtgaagatgatgaggatgaaaacctttgtgatgatccacttccacttaatgaatggttcctcgtctcctcttccttggaccaaaagtcagaggcaagaatgccctcattcataccccagtggtctatacctccagcagcaagtcgagtgagcaagtgatgtcctgaaaggcccagtggatcagtggaatgaagcgggcaggaagacttagtgctcctgaaacaaggaatccagaatccaggagaaggatggctcagtggggctttcaagggacaagtatgggggttgaaggggtcactgtccctataccaaatccgaaaatattgtgaccaggaaccattctgtccaactcttctatttcaggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagacccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 369668 - DNA, 1108 bp, Homo sapiens
tctagaggatccttgtcgacttctgctctgcgttgaccgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 369669 - DNA, 3699 bp, Homo sapiens
attctactctccgctgaagtccacacagtttaaattaaagttcccggatttttgtgggcgcctgccccgcccctcgtccccctgctgtgtccatatatcgaggcgatagggttaagggaaggcggacgcctgatgggttaatgagcaaactgaagtgttttccatgatcttttttgagtcgcaattgaagtaccacctcccgagggtgattgcttccccatgcggggtagaacctttgctgtcctgttcaccactctacctccagcacagaatttggcttatgcctactcaatgtgaagatgatgaggatgaaaacctttgtgatgatccacttccacttaatgaatggttcctcgtctcctcttccttggaccaaaagtcagaggcaagaatgccctcattcataccccagtggtctatacctccagcagcaagtcgagtgagcaagtgatgtcctgaaaggcccagtggatcagtggaatgaagcgggcaggaagacttagtgctcctgaaacaaggaatccagaatccaggagaaggatggctcagtggggctttcaagggacaagtatgggggttgaaggggtcactgtccctataccaaatccgaaaatattgtgaccaggaaccattctgtccaactcttctatttcaggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaattggatgattgactctgaatgtgcagccagccatagtgggatcgctctagat

SEQ ID NO: 369670 - DNA, 3693 bp, Homo sapiens
attctactctccgctgaagtccacacagtttaaattaaagttcccggatttttgtgggcgcctgccccgcccctcgtccccctgctgtgtccatatatcgaggcgatagggttaagggaaggcggacgcctgatgggttaatgagcaaactgaagtgttttccatgatcttttttgagtcgcaattgaagtaccacctcccgagggtgattgcttccccatgcggggtagaacctttgctgtcctgttcaccactctacctccagcacagaatttggcttatgcctactcaatgtgaagatgatgaggatgaaaacctttgtgatgatccacttccacttaatgaatggttcctcgtctcctcttccttggaccaaaagtcagaggcaagaatgccctcattcataccccagtggtctatacctccagcagcaagtcgagtgagcaagtgatgtcctgaaaggcccagtggatcagtggaatgaagcgggcaggaagacttagtgctcctgaaacaaggaatccagaatccaggagaaggatggctcagtggggctttcaagggacaagtatgggggttgaaggggtcactgtccctataccaaatccgaaaatattgtgaccaggaaccattctgtccaactcttctatttcaggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttagcccatgagctggtgaccagcaagattgcactacggaaggacctggataacgctgaggaaaaggcagatgctctgaataaggagctgctgatgaccaaacagaatttgattgatgcagaagaagagaaaagacggctggaagaagagtctgctcagttaaaaga

SEQ ID NO: 369671 - DNA, 932 bp, Homo sapiens
caacgcatgtgccgctcccaacgatgtgccgctcccaacgcatgtgccgctcccaacgcatgtactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 369672 - DNA, 3427 bp, Homo sapiens
attctactctccgctgaagtccacacagtttaaattaaagttcccggatttttgtgggcgcctgccccgcccctcgtccccctgctgtgtccatatatcgaggcgatagggttaagggaaggcggacgcctgatgggttaatgagcaaactgaagtgttttccatgatcttttttgagtcgcaattgaagtaccacctcccgagggtgattgcttccccatgcggggtagaacctttgctgtcctgttcaccactctacctccagcacagaatttggcttatgcctactcaatgtgaagatgatgaggatgaaaacctttgtgatgatccacttccacttaatgaatggttcctcgtctcctcttccttggaccaaaagtcagaggcaagaatgccctcattcataccccagtggtctatacctccagcagcaagtcgagtgagcaagtgatgtcctgaaaggcccagtggatcagtggaatgaagcgggcaggaagacttagtgctcctgaaacaaggaatccagaatccaggagaaggatggctcagtggggctttcaagggacaagtatgggggttgaaggggtcactgtccctataccaaatccgaaaatattgtgaccaggaaccattctgtccaactcttctatttcaggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccaggttggcctggaccccaggatgtacccttcattgcccttcactcccccactggatgctgggtggtcactgctgtagggaggggaccccctgacatatgtcccttcccacccactcttccactgtggaacctcctgtcattttccacttcaccaagtgacagaggacctgctcagatgctgaggggaggggactgcaaggaaagatggctaggaaacccagtccctccacaccctagagtaacttgatgccttgtgagggacacaggcaaagttcaattccttggaagtcaagggagactgagaagagtacagctgcagcactgagggagtgatgaattcttaactggggatggtgggaggcttcgagtgggaggtggcatttgagctaggctttgagagaggagcaggtattgcacttgcatttaggtagaaagcattggggtgcaaggtgacactggagggggaggcatcaggaaatccaggatgtcttcaaagttctggtgtcgggggctgttgagtaagcacaggaataagggggtcaagttagagtcagggtggggtctgacctggatgccataggacctgatccccaagccacagggtgggacttgactgggcagtggggacctttggaaaggactttggggagaccaacctgtagtcttgcctatagcaacatccggcccgggtggagcatgtgtacccg

SEQ ID NO: 369673 - DNA, 2526 bp, Homo sapiens
attctactctccgctgaagtccacacagtttaaattaaagttcccggatttttgtgggcgcctgccccgcccctcgtccccctgctgtgtccatatatcgaggcgatagggttaagggaaggcggacgcctgatgggttaatgagcaaactgaagtgttttccatgatcttttttgagtcgcaattgaagtaccacctcccgagggtgattgcttccccatgcggggtagaacctttgctgtcctgttcaccactctacctccagcacagaatttggcttatgcctactcaatgtgaagatgatgaggatgaaaacctttgtgatgatccacttccacttaatgaatggttcctcgtctcctcttccttggaccaaaagtcagaggcaagaatgccctcattcataccccagtggtctatacctccagcagcaagtcgagtgagcaagtgatgtcctgaaaggcccagtggatcagtggaatgaagcgggcaggaagacttagtgctcctgaaacaaggaatccagaatccaggagaaggatggctcagtggggctttcaagggacaagtatgggggttgaaggggtcactgtccctataccaaatccgaaaatattgtgaccaggaaccattctgtccaactcttctatttcaggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtggtaagacagggagcccagtgtgcgcactccccatctgccagcacacagcagtgcccagggggccctggcagcagcgttcttggacttgtgcagactgcccgtctctgtgcacccttcttgactcagcacagctctggctggcttggcctcttggcatggcttctctagctgggtcctacctgccttggcatccttccctccccctctgtttctgaaatctcagaactcttcctctcc

SEQ ID NO: 369674 - DNA, 314 bp, Homo sapiens
tcatcagctcggcccatttatgcgtgctaagggggatgctcttaaggttatcgtgtaagcatgcaagcttgcgcattcgagcgactgtctcatgacgtctatggtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 369675 - DNA, 467 bp, Homo sapiens
gtatgtgcctctgctttgtgcccaatgtgctctaccccccaggatgcaaggggtgggcaccctgcctggtactgccctattgcccctggcacaccagggcaaaacagcacagtgaaagccagccacctgtccccccaggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctgtgagtgccagggagaaacacagttttctcattttggtggggaggtttgtttctgtaaatgggagcatatggggagcactgtctgcatcttgctttgagagctggtcatgacagttcctgccgagctgccttgttctttcaacagctgtggagcaggtggcagtaaggagaggcagctaagagccca

SEQ ID NO: 369676 - DNA, 271 bp, Homo sapiens
gagcccagtgtgcgcactccccatctgccagcacacagcagtgcccagggggccctggcagcagcgttcttggacttgtgcagactgcccgtctctgtgcacccttcttgactcagcacagctctggctggcttggcctcttggcatggcttctctagctgggtcctacctgccttggcatccttccctccccctctgtttctgaaatctcagaactcttcctctccctacatcggccccacctgtccccacccctccagcccacagccat

SEQ ID NO: 369677 - DNA, 514 bp, Homo sapiens
  misc_feature (513)..(513): n is a, c, g, or t
caacgcatgtgccgctcccaacgatgtgccgctcccaacgcatgtgccgctcccaacgcatgtgccgctcccaacgcatgtgccgctcccaacgcatgtgccgctcccaacgcatgtgccgctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggcacatgcgttgggggatcctctagng

SEQ ID NO: 369678 - DNA, 4556 bp, Homo sapiens
  misc_feature (32)..(33): n is a, c, g, or t
aaggggaggtaaccctggcccctttggtcggnnccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 369679 - DNA, 5158 bp, Homo sapiens
attctactctccgctgaagtccacacagtttaaattaaagttcccggatttttgtgggcgcctgccccgcccctcgtccccctgctgtgtccatatatcgaggcgatagggttaagggaaggcggacgcctgatgggttaatgagcaaactgaagtgttttccatgatcttttttgagtcgcaattgaagtaccacctcccgagggtgattgcttccccatgcggggtagaacctttgctgtcctgttcaccactctacctccagcacagaatttggcttatgcctactcaatgtgaagatgatgaggatgaaaacctttgtgatgatccacttccacttaatgaatggttcctcgtctcctcttccttggaccaaaagtcagaggcaagaatgccctcattcataccccagtggtctatacctccagcagcaagtcgagtgagcaagtgatgtcctgaaaggcccagtggatcagtggaatgaagcgggcaggaagacttagtgctcctgaaacaaggaatccagaatccaggagaaggatggctcagtggggctttcaagggacaagtatgggggttgaaggggtcactgtccctataccaaatccgaaaatattgtgaccaggaaccattctgtccaactcttctatttcaggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 369680 - DNA, 4851 bp, Homo sapiens
attctactctccgctgaagtccacacagtttaaattaaagttcccggatttttgtgggcgcctgccccgcccctcgtccccctgctgtgtccatatatcgaggcgatagggttaagggaaggcggacgcctgatgggttaatgagcaaactgaagtgttttccatgatcttttttgagtcgcaattgaagtaccacctcccgagggtgattgcttccccatgcggggtagaacctttgctgtcctgttcaccactctacctccagcacagaatttggcttatgcctactcaatgtgaagatgatgaggatgaaaacctttgtgatgatccacttccacttaatgaatggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 369681 - DNA, 4400 bp, Homo sapiens
  misc_feature (6)..(6): n is a, c, g, or t
  misc_feature (22)..(22): n is a, c, g, or t
  misc_feature (38)..(38): n is a, c, g, or t
aaaaantcaaatgtcttgttgnggacatgcaaaaaatnaaatacttcaaagattccagaagatatgccccgggggtcctggaagccacaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 369682 - DNA, 5280 bp, Homo sapiens
attctactctccgctgaagtccacacagtttaaattaaagttcccggatttttgtgggcgcctgccccgcccctcgtccccctgctgtgtccatatatcgaggcgatagggttaagggaaggcggacgcctgatgggttaatgagcaaactgaagtgttttccatgatcttttttgagtcgcaattgaagtaccacctcccgagggtgattgcttccccatgcggggtagaacctttgctgtcctgttcaccactctacctccagcacagaatttggcttatgcctactcaatgtgaagatgatgaggatgaaaacctttgtgatgatccacttccacttaatgaatggttcctcgtctcctcttccttggaccaaaagtcagaggcaagaatgccctcattcataccccagtggtctatacctccagcagcaagtcgagtgagcaagtgatgtcctgaaaggcccagtggatcagtggaatgaagcgggcaggaagacttagtgctcctgaaacaaggaatccagaatccaggagaaggatggctcagtggggctttcaagggacaagtatgggggttgaaggggtcactgtccctataccaaatccgaaaatattgtgaccaggaaccattctgtccaactcttctatttcaggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggttaggtgaaggaccaaggagcagaggaggctgggtggagtggtgtctagcccatgggagaactctgagtggccacctccccacaacacacagttggaggacttcctcttctgccctcccaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 369683 - DNA, 3175 bp, Homo sapiens
agcggccgctcgcgatctagaactagtctggggacccagcctccaacctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 369684 - DNA, 4718 bp, Homo sapiens
attctactctccgctgaagtccacacagtttaaattaaagttcccggatttttgtgggcgcctgccccgcccctcgtccccctgctgtgtccatatatcgaggcgatagggttaagggaaggcggacgcctgatgggttaatgagcaaactgaagtgttttccatgatcttttttgagtcgcaattgaagtaccacctcccgagggtgattgcttccccatgcggggtagaacctttgctgtcctgttcaccactctacctccagcacagaatttggcttatgcctactcaatgtgaagatgatgaggatgaaaacctttgtgatgatccacttccacttaatgaatggttcctcgtctcctcttccttggaccaaaagtcagaggcaagaatgccctcattcataccccagtggtctatacctccagcagcaagtcgagtgagcaagtgatgtcctgaaaggcccagtggatcagtggaatgaagcgggcaggaagacttagtgctcctgaaacaaggaatccagaatccaggagaaggatggctcagtggggctttcaagggacaagtatgggggttgaaggggtcactgtccctataccaaatccgaaaatattgtgaccaggaaccattctgtccaactcttctatttcaggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 369685 - DNA, 5475 bp, Homo sapiens
attctactctccgctgaagtccacacagtttaaattaaagttcccggatttttgtgggcgcctgccccgcccctcgtccccctgctgtgtccatatatcgaggcgatagggttaagggaaggcggacgcctgatgggttaatgagcaaactgaagtgttttccatgatcttttttgagtcgcaattgaagtaccacctcccgagggtgattgcttccccatgcggggtagaacctttgctgtcctgttcaccactctacctccagcacagaatttggcttatgcctactcaatgtgaagatgatgaggatgaaaacctttgtgatgatccacttccacttaatgaatggttcctcgtctcctcttccttggaccaaaagtcagaggcaagaatgccctcattcataccccagtggtctatacctccagcagcaagtcgagtgagcaagtgatgtcctgaaaggcccagtggatcagtggaatgaagcgggcaggaagacttagtgctcctgaaacaaggaatccagaatccaggagaaggatggctcagtggggctttcaagggacaagtatgggggttgaaggggtcactgtccctataccaaatccgaaaatattgtgaccaggaaccattctgtccaactcttctatttcaggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgcctctgtgacaccccctgacctatggaagggaactcatgttggccggacattttaccatgtgccaggcactgcgggcactttacataaagcagccaatgtcagaactagaaagcgggagagctgggattcagagcacagactgacccagcaggtgttctgcgagcctcacctgtgcccccgaggcgcgactcgatctcgatgcccggatactgctccttcacagcactggccagctccaggtaggtcgcctcgaagccgcagggttcactggggagtcaagagatggggctgggctggggattcgggggtggggcctcccgtggacccacctccgtccggcccgcgggaccagggtgcgggtcctccagccggggccgctcaccagtactccaccacgatgcggaccccactgcccggctcgacctcctcgggagggggcgctacggacgtctgccccggctccccgctcatcgcggccggctccgctcgggc

SEQ ID NO: 369686 - DNA, 2482 bp, Homo sapiens
ctctggcgtgatggcccattaaacgatagagtcaagaggtctctaatgcaaaaggccattgagtctcactcacctccttgcttgcttcattctcctcagctacactggctttgagggccagtttttacattgggacctggtagcccacaccacctgttcttgaactcctgacctcatgatccgcccgcctcggcctcccaaagtgctgggattacaggtgtgagccaccgtgcccggcctaatctttgtatttttagtagagacagggtttcaccatgttgtccaggctggtactttgagccttcacaggctgtgggccatggctgtggtttgtgatggttgggaggctgtgtggtgtttgggggtgtgtggtctcccataccctctcagcgtacccttgtccccaggaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 369687 - DNA, 1758 bp, Homo sapiens
gcgtcggttcctggcagatgggggagtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 369688 - DNA, 4232 bp, Homo sapiens
attctactctccgctgaagtccacacagtttaaattaaagttcccggatttttgtgggcgcctgccccgcccctcgtccccctgctgtgtccatatatcgaggcgatagggttaagggaaggcggacgcctgatgggttaatgagcaaactgaagtgttttccatgatcttttttgagtcgcaattgaagtaccacctcccgagggtgattgcttccccatgcggggtagaacctttgctgtcctgttcaccactctacctccagcacagaatttggcttatgcctactcaatgtgaagatgatgaggatgaaaacctttgtgatgatccacttccacttaatgaatggttcctcgtctcctcttccttggaccaaaagtcagaggcaagaatgccctcattcataccccagtggtctatacctccagcagcaagtcgagtgagcaagtgatgtcctgaaaggcccagtggatcagtggaatgaagcgggcaggaagacttagtgctcctgaaacaaggaatccagaatccaggagaaggatggctcagtggggctttcaagggacaagtatgggggttgaaggggtcactgtccctataccaaatccgaaaatattgtgaccaggaaccattctgtccaactcttctatttcaggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagagagagcgtcgtcattcttgcaacggaagggccggttgggagggcacacgaaccgggcacactcctcggggttctactgagttgtccccaacagagagagcgtc

SEQ ID NO: 369689 - DNA, 3755 bp, Homo sapiens
attctactctccgctgaagtccacacagtttaaattaaagttcccggatttttgtgggcgcctgccccgcccctcgtccccctgctgtgtccatatatcgaggcgatagggttaagggaaggcggacgcctgatgggttaatgagcaaactgaagtgttttccatgatcttttttgagtcgcaattgaagtaccacctcccgagggtgattgcttccccatgcggggtagaacctttgctgtcctgttcaccactctacctccagcacagaatttggcttatgcctactcaatgtgaagatgatgaggatgaaaacctttgtgatgatccacttccacttaatgaatggttcctcgtctcctcttccttggaccaaaagtcagaggcaagaatgccctcattcataccccagtggtctatacctccagcagcaagtcgagtgagcaagtgatgtcctgaaaggcccagtggatcagtggaatgaagcgggcaggaagacttagtgctcctgaaacaaggaatccagaatccaggagaaggatggctcagtggggctttcaagggacaagtatgggggttgaaggggtcactgtccctataccaaatccgaaaatattgtgaccaggaaccattctgtccaactcttctatttcaggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaataagcatacgtgatggctggtgtgggctccccagccctgaaaccagtgtcaccagcctctccaccaaacaacaacctacaaacagcacaggactcacccaagcctagg

SEQ ID NO: 369690 - DNA, 3622 bp, Homo sapiens
  misc_feature (3621)..(3621): n is a, c, g, or t
attctactctccgctgaagtccacacagtttaaattaaagttcccggatttttgtgggcgcctgccccgcccctcgtccccctgctgtgtccatatatcgaggcgatagggttaagggaaggcggacgcctgatgggttaatgagcaaactgaagtgttttccatgatcttttttgagtcgcaattgaagtaccacctcccgagggtgattgcttccccatgcggggtagaacctttgctgtcctgttcaccactctacctccagcacagaatttggcttatgcctactcaatgtgaagatgatgaggatgaaaacctttgtgatgatccacttccacttaatgaatggttcctcgtctcctcttccttggaccaaaagtcagaggcaagaatgccctcattcataccccagtggtctatacctccagcagcaagtcgagtgagcaagtgatgtcctgaaaggcccagtggatcagtggaatgaagcgggcaggaagacttagtgctcctgaaacaaggaatccagaatccaggagaaggatggctcagtggggctttcaagggacaagtatgggggttgaaggggtcactgtccctataccaaatccgaaaatattgtgaccaggaaccattctgtccaactcttctatttcaggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggcacatgcgttgggggatcctctagng

SEQ ID NO: 369691 - DNA, 793 bp, Homo sapiens
gggtgtcaattactcggggttctccacggccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaaca

SEQ ID NO: 369692 - DNA, 2842 bp, Homo sapiens
attctactctccgctgaagtccacacagtttaaattaaagttcccggatttttgtgggcgcctgccccgcccctcgtccccctgctgtgtccatatatcgaggcgatagggttaagggaaggcggacgcctgatgggttaatgagcaaactgaagtgttttccatgatcttttttgagtcgcaattgaagtaccacctcccgagggtgattgcttccccatgcggggtagaacctttgctgtcctgttcaccactctacctccagcacagaatttggcttatgcctactcaatgtgaagatgatgaggatgaaaacctttgtgatgatccacttccacttaatgaatggttcctcgtctcctcttccttggaccaaaagtcagaggcaagaatgccctcattcataccccagtggtctatacctccagcagcaagtcgagtgagcaagtgatgtcctgaaaggcccagtggatcagtggaatgaagcgggcaggaagacttagtgctcctgaaacaaggaatccagaatccaggagaaggatggctcagtggggctttcaagggacaagtatgggggttgaaggggtcactgtccctataccaaatccgaaaatattgtgaccaggaaccattctgtccaactcttctatttcaggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcgtgagtccaacggtcttttctgcagaaaggaggactttcctttcaggggtctttctggggctcttactataaaaggggaccaactctccctttgtcatatcttgtttctgatgacaaaaataacacattgttaaaattgtaaaattaaaacatgaaatataaattaat

SEQ ID NO: 369693 - DNA, 2006 bp, Homo sapiens
attctactctccgctgaagtccacacagtttaaattaaagttcccggatttttgtgggcgcctgccccgcccctcgtccccctgctgtgtccatatatcgaggcgatagggttaagggaaggcggacgcctgatgggttaatgagcaaactgaagtgttttccatgatcttttttgagtcgcaattgaagtaccacctcccgagggtgattgcttccccatgcggggtagaacctttgctgtcctgttcaccactctacctccagcacagaatttggcttatgcctactcaatgtgaagatgatgaggatgaaaacctttgtgatgatccacttccacttaatgaatggttcctcgtctcctcttccttggaccaaaagtcagaggcaagaatgccctcattcataccccagtggtctatacctccagcagcaagtcgagtgagcaagtgatgtcctgaaaggcccagtggatcagtggaatgaagcgggcaggaagacttagtgctcctgaaacaaggaatccagaatccaggagaaggatggctcagtggggctttcaagggacaagtatgggggttgaaggggtcactgtccctataccaaatccgaaaatattgtgaccaggaaccattctgtccaactcttctatttcaggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctgtgagtgccagggagaaacacagttttctcattttggtggggaggtttgtttctgtaaatgggagcatatggggagcactgtctgcatcttgctttgagagctggtcatgacagttcctgccgagctgccttgttctttcaacagctgtggagcaggtggcagtaaggagaggcagctaagagcccagacttgggagccagactgcctgggtttgaaacccagctctatcaattagtaggcacgtgaccctcttgctgtgcctcagtttcctcatcagtaaaatgggggcaagaatagtcccaactgcataagatggttataacatttg

SEQ ID NO: 369694 - DNA, 873 bp, Homo sapiens
gccctgacggcgctcccgggagcagccggtgcgcggcggcggcacgaccccctgcgcctccgaggcagacgagcccatcgggagaaggcgaggcagggaagtgcctaaaccaacgggataggattcaaaactaggtgacaaactcatgagaaatccaacctggctgaatgtctgagaggctgctactgtatcaacatcacaagataaagcactctggtatcacctgcccatatcctccttagtgtcacccaagacatttgactctgatgtggttaattgataacttttcttgctccactttacaatgttttgtttcctacatcttattaccttgggacacaaaagtggcagagttgttgagagctgatgacaataaaaaggagaacactagaggaaatgagacaggaaagaaagccaaagctgattttccaactctatgctgactccaacctgcagaaaaagctgaatatagaaatcttcttccatatatgatgaagtcactccacttacgacataacacacaaaggaatcacctggctttttttttttaacccagaagagttgtgctggggaccatgccccatcccgctgatacagatcctgaatggaataatcaggaatggcacagtgcaggtgtcaatatcaaagtaaggccgcagaatttttgagaggaccctccaaatactgagaacttctgttgcactcgaaacagtctcctggatttctatatttttatgtgaagggctcttattgatgtcccccagaatccagactcagacctatttctccaaaaaggtccaattgggttgctacatagtagcaagggtttatcttcatgctcacctagcattccaggcccccattacttcaaaa

SEQ ID NO: 369695 - DNA, 854 bp, Homo sapiens
gccctgacggcgctcccgggagcagccggtgcgcggcggcggcacgaccccctgcgcctccgaggcagacgagcccatcgggagaagaaaccaacgggataggattcaaaactaggtgacaaactcatgagaaatccaacctggctgaatgtctgagaggctgctactgtatcaacatcacaagataaagcactctggtatcacctgcccatatcctccttagtgtcacccaagacatttgactctgatgtggttaattgataacttttcttgctccactttacaatgttttgtttcctacatcttattaccttgggacacaaaagtggcagagttgttgagagctgatgacaataaaaaggagaacactagaggaaatgagacaggaaagaaagccaaagctgattttccaactctatgctgactccaacctgcagaaaaagctgaatatagaaatcttcttccatatatgatgaagtcactccacttacgacataacacacaaaggaatcacctggctttttttttttaacccagaagagttgtgctggggaccatgccccatcccgctgatacagatcctgaatggaataatcaggaatggcacagtgcaggtgtcaatatcaaagtaaggccgcagaatttttgagaggaccctccaaatactgagaacttctgttgcactcgaaacagtctcctggatttctatatttttatgtgaagggctcttattgatgtcccccagaatccagactcagacctatttctccaaaaaggtccaattgggttgctacatagtagcaagggtttatcttcatgctcacctagcattccaggcccccattacttcaaaa

SEQ ID NO: 369696 - DNA, 2257 bp, Homo sapiens
gaattgattctcggcctcctgtccccttctttagcgcgcccttggctctcggatctcccttgtgctgtttctcaagcctgcccgtgtccccccggctttgttttatttgtgggagtacctccgccgcctgttttggtgccccgcgttcttcccttgggaccccccttgttgcaccgtgtttctactgttcctatctggtgcccccgcgtctacaccgagttggggttttcgcaaccctttttgtggtgcccataggcgcgccgatgagttttttttttttttctttttcttttttttactttttatcaaagaagtttatttgcatgtaaataaacaggttattttgtaatgtttcgggaaaaaaatcccacaacagatttcatctactttcaaaaaaatgaaaaaccccaaagtatttacaaaacggccatatgcacagaaaaccaaatttgaaagatttttttaaaaaaagaccctccccagctgctcctgatgtacatttttaaactcaaaatttaaagctcagttcttatagctgagcatgtttcccaatctagcttctgagatgttaagtacttcctgcccctccaaaactaactcaaggatagaaatgtatggggggcaggggaggaggggagaaggaaaaaaaaatgagattgcccaaggattgtgaataatgtttcgtatactgacatctttaagtgactcaactgtggatactgtatgactcactggctccctgaaagggcttctgagaattcatgatattgctgcacttaattttctgatctaggcctgaagaaagaaaatctttcaagagtcaccaacctcaagcctggttttggcaattatatcctgcgttgtttgtccccaccaccccaccccccacccgctaaaatacttctgttttaagacacattgatattgaacctgaaatctttatgtacatcagagcaggttatgaccaagaacccctaatgttaagtcaaaagacagaagaggaatcaggtcaaactgagaatacataagacaccagcagcagaagataggtagaagttgacttcatgtccttgccttcttttgaaacagaagaatgagtacacctagacaggagggaggtgtcccaggcttggtttattctgcctcttctcctccaccctgtggagaaatgcagtgctccctggttctcaggcagggtgaagcagtttagccccggctccctgttaagcaagttcagatgctgggtcagtgtgggggtgagcccatcgacaattcaggggcttatccttcatccagatcctaactcgggattctttgatctgggatgaagacagaaagagagaaaagcttcccagtttactcattttggtatttgttggccctgcatgggggagctgagcccatgatactattcagtacattccccctaagattctccccactcagaaccaattttaaaaaccacataaatttttttttttttcctgcagaaaccaacgggataggattcaaaactaggtgacaaactcatgagaaatccaacctggctgaatgtctgagaggctgctactgtatcaacatcacaagataaagcactctggtatcacctgcccatatcctccttagtgtcacccaagacatttgactctgatgtggttaattgataacttttcttgctccactttacaatgttttgtttcctacatcttattaccttgggacacaaaagtggcagagttgttgagagctgatgacaataaaaaggagaacactagaggaaatgagacaggaaagaaagccaaagctgattttccaactctatgctgactccaacctgcagaaaaagctgaatatagaaatcttcttccatatatgatgaagtcactccacttacgacataacacacaaaggaatcacctggctttttttttttaacccagaagagttgtgctggggaccatgccccatcccgctgatacagatcctgaatggaataatcaggaatggcacagtgcaggtgtcaatatcaaagtaaggccgcagaatttttgagaggaccctccaaatactgagaacttctgttgcactcgaaacagtctcctggatttctatatttttatgtgaagggctcttattgatgtcccccagaatccagactcagacctatttctccaaaaaggtccaattgggttgctacatagtagcaagggtttatcttcatgctcacctagcattccaggcccccattacttcaaaa

SEQ ID NO: 369697 - DNA, 387 bp, Homo sapiens
ttcagttctaagcttctacaatctatgacatttcttgtgaccctgtctggaggagactgctgggagttccctggaaggctgctgactggctgggcactgagcaaacccgagggtgcctcagcaaccaggctccaatgccaggcatccaggcatggcaggcagccactggctgcaggttagtgtgaccctctcggagattcgtgctgccctcctgccagggaaatggctcaagttgtcacgacagagcatgaccctgagatagaagctggggggtggtgcccccgtgcaatgagctttgcttgtttgtgcaggcttccttggagcctcacgtagccaggctcagctgctctgccaccctttaggctgctgggtagccagagtaaggag

SEQ ID NO: 369698 - DNA, 424 bp, Homo sapiens
ctccatcttctaggatacaaaagtgcttctcccatagttgagaaaaatagtaactatttttaccaaaaacacctgtttcagaagcctcttaacaccacaatctccacgagcttaatgtgctaagaatggtttaaagaatctcctgctattatttaggttgatttcctattcttaaaataatgatggaataaaacaccctgtatcattcatgtctgtgtatgaactttccattctaattagtaagatttttggagtcagaaacaaagtaactcactaaattacctaaaaatatagtataaaatcagggagaaaaggtttccccttatttgtctccttttctaggatttagccacatacttcgtggacatgagtacgtgacttcattggcagctgctctatcgtgcgtacagagagtaagttgcat

SEQ ID NO: 369699 - DNA, 209 bp, Homo sapiens
tcagctaagtcaagagatgatgtcttaaaagcaggacaaaagaagattattacctcttttgttcttgaaaaagatattgcaaacactggataccatgtttagtaagtacattgaggtatagttgactgtgcatatttagaatgtacggtttaataagtattgacgtgtgcacatgtgcatacccgtgaaaacgccacggtcaaggcaat

SEQ ID NO: 369700 - DNA, 288 bp, Homo sapiens
tgctcctctgggcgcatcactcctgtttgcaagcatcttaggaaagataaagggctaggcttctgtgaggctcctctgagtccggacaaccgtgcactgtctggtttcagcgagacccctgtccattcacgtataaggaggtttctgctccactcacaggatcctgagctgcacttacctgtgagagtcttcaaacttttaaaccttgccagtcaggacttttgctattgcaaatagaaaacccaactcaacctgcttaagcagaaaataaatttattgattcaagtt

SEQ ID NO: 369701 - DNA, 1561 bp, Homo sapiens
agagggcccccaggtctcctgctggagcctccacgcagggggcctgtggggatggccagggctcagcccagcacctgagcgcccctcccaccagctgctctgccagaccgcatgctccgccccctgcaaacgaccgtggggagagcagcttgaaaacgcgcctggccctgagctgtcaccaccgacactctccaggctccggacacgatgcaggccatcaagtgtgtggtggtgggagatggggccgtgggcaagacctgccttctcatcagctacaccaccaacgcctttcccggagagtacatccccaccgtgtttgacaactattcagccaatgtgatggtggacagcaagccagtgaacctggggctgtgggacactgctgggcaggaggactacgaccgtctccggccgctctcctatccacagacggacgtcttcctcatctgcttctccctcgtcagcccagcctcttatgagaacgtccgcgccaagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattgactcggtgaaatacctggagtgctcagctctcacccagagaggcctgaaaaccgtgttcgacgaggccatccgggccgtgctgtgccctcagcccacgcggcagcagaagcgcgcctgcagcctcctctaggggttgcaccccagcgctcccacctagatgggtctgatcctccaggatccccacccaaagcctgatggcaccccggctggccatgctgtcccctccctgtggcgtttcttagcagatggctgcagagcttcgttgatggtcttttctgtactggaggcctcctgaggccaggaacgtgcaaatttgcaggtgctgcatcccaagcccctcatgctcctgccttcctgagggccagaggggagccccaggacccattaagccacccccgtgttcctgccgtcagtgccaactgccgcatgtggaagcatctacccgttcactccagtcccaccccacgcctgactcccctctggaaactgcaggccagatggttgctgccacaacttgtgtaccttcagggatggggctcttactccctcctgaggccagctgctctaatatcgatggtcctgcttgccagagagttcctctacccagcaaaaatgagtgtctcagaagtgtgctcctctggcctcagttctcctcttttggaacaacataaaacaaatttaattttctacgcctctggggatatctgctcagccaatggaaaatctgggttcaaccagcccctgccatttcttaagactttctgctccactcacaggatcctgagctgcacttacctgtgagagtcttcaaacttttaaaccttgccagtcaggacttttgctattgcaaatagaaaacccaactcaacctgcttaagcagaaaataaatttattgattcaagtt

SEQ ID NO: 369702 - DNA, 1627 bp, Homo sapiens
agagggcccccaggtctcctgctggagcctccacgcagggggcctgtggggatggccagggctcagcccagcacctgagcgcccctcccaccagctgctctgccagaccgcatgctccgccccctgcaaacgaccgtggggagagcagcttgagtaagttccccttccgtttcctcctgccccaccaccgctgctcctcagcaggcgcctcaccagcctccacaccccttgcgcccgcagaaacgcgcctggccctgagctgtcaccaccgacactctccaggctccggacacgatgcaggccatcaaggccgtgggcaagacctgccttctcatcagctacaccaccaacgcctttcccggagagtacatccccaccgtgtttgacaactattcagccaatgtgatggtggacagcaagccagtgaacctggggctgtgggacactgctgggcaggaggactacgaccgtctccggccgctctcctatccacagacggacgtcttcctcatctgcttctccctcgtcagcccagcctcttatgagaacgtccgcgccaagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattgactcggtgaaatacctggagtgctcagctctcacccagagaggcctgaaaaccgtgttcgacgaggccatccgggccgtgctgtgccctcagcccacgcggcagcagaagcgcgcctgcagcctcctctaggggttgcaccccagcgctcccacctagatgggtctgatcctccaggatccccacccaaagcctgatggcaccccggctggccatgctgtcccctccctgtggcgtttcttagcagatggctgcagagcttcgttgatggtcttttctgtactggaggcctcctgaggccaggaacgtgcaaatttgcaggtgctgcatcccaagcccctcatgctcctgccttcctgagggccagaggggagccccaggacccattaagccacccccgtgttcctgccgtcagtgccaactgccgcatgtggaagcatctacccgttcactccagtcccaccccacgcctgactcccctctggaaactgcaggccagatggttgctgccacaacttgtgtaccttcagggatggggctcttactccctcctgaggccagctgctctaatatcgatggtcctgcttgccagagagttcctctacccagcaaaaatgagtgtctcagaagtgtgctcctctggcctcagttctcctcttttggaacaacataaaacaaatttaattttctacgcctctggggatatctgctcagccaatggaaaatctgggttcaaccagcccctgccatttcttaagactttctgctccactcacaggatcctgagctgcacttacctgtgagagtcttcaaacttttaaaccttgccagtcaggacttttgctattgcaaatagaaaacccaactcaacctgcttaagcagaaaataaatttattgattcaagtt

SEQ ID NO: 369703 - DNA, 1303 bp, Homo sapiens
gccagccccgagtgtgatttcaatagggggcttggcgtgtagatgtatccctgggcgtttgacaactattcagccaatgtgatggtggacagcaagccagtgaacctggggctgtgggacactgctgggcaggaggactacgaccgtctccggccgctctcctatccacagacggacgtcttcctcatctgcttctccctcgtcagcccagcctcttatgagaacgtccgcgccaagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattgactcggtgaaatacctggagtgctcagctctcacccagagaggcctgaaaaccgtgttcgacgaggccatccgggccgtgctgtgccctcagcccacgcggcagcagaagcgcgcctgcagcctcctctaggggttgcaccccagcgctcccacctagatgggtctgatcctccaggatccccacccaaagcctgatggcaccccggctggccatgctgtcccctccctgtggcgtttcttagcagatggctgcagagcttcgttgatggtcttttctgtactggaggcctcctgaggccaggaacgtgcaaatttgcaggtgctgcatcccaagcccctcatgctcctgccttcctgagggccagaggggagccccaggacccattaagccacccccgtgttcctgccgtcagtgccaactgccgcatgtggaagcatctacccgttcactccagtcccaccccacgcctgactcccctctggaaactgcaggccagatggttgctgccacaacttgtgtaccttcagggatggggctcttactccctcctgaggccagctgctctaatatcgatggtcctgcttgccagagagttcctctacccagcaaaaatgagtgtctcagaagtgtgctcctctggcctcagttctcctcttttggaacaacataaaacaaatttaattttctacgcctctggggatatctgctcagccaatggaaaatctgggttcaaccagcccctgccatttcttaagactttctgctccactcacaggatcctgagctgcacttacctgtgagagtcttcaaacttttaaaccttgccagtcaggacttttgctattgcaaatagaaaacccaactcaacctgcttaagcagaaaataaatttattgattcaagtt

SEQ ID NO: 369704 - DNA, 1580 bp, Homo sapiens
agagggcccccaggtctcctgctggagcctccacgcagggggcctgtggggatggccagggctcagcccagcacctgagcgcccctcccaccagctgctctgccagaccgcatgctccgccccctgcaaacgaccgtggggagagcagcttgagtaagttccccttccgtttcctcctgccccaccaccgctgctcctcagcaggcgcctcaccagcctccacaccccttgcgcccgcagaaacgcgcctggccctgagctgtcaccaccgacactctccaggctccggacacgatgcaggccatcaagtgtgtggtggtgggagatggggccgtgggcaagacctgccttctcatcagctacaccaccaacgcctttcccggagagtacatccccaccgtgtttgacaactattcagccaatgtgatggtggacagcaagccagtgaacctggggctgtgggacactgctgggcaggaggactacgaccgtctccggccgctctcctatccacagacggacgtcttcctcatctgcttctccctcgtcagcccagcctcttatgagaacgtccgcgccaagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattgactcggtgaaatacctggagtgctcagctctcacccagagaggcctgaaaaccgtgttcgacgaggccatccgggccgtgctgtgccctcagcccacgcggcagcagaagcgcgcctgcagcctcctctaggggttgcaccccagcgctcccacctagatgggtctgatcctccaggatccccacccaaagcctgatggcaccccggctggccatgctgtcccctccctgtggcgtttcttagcagatggctgcagagcttcgttgatggtcttttctgtactggaggcctcctgaggccaggaacgtgcaaatttgcaggtgctgcatcccaagcccctcatgctcctgccttcctgagggccagaggggagccccaggacccattaagccacccccgtgttcctgccgtcagtgccaatgcaggccagatggttgctgccacaacttgtgtaccttcagggatggggctcttactccctcctgaggccagctgctctaatatcgatggtcctgcttgccagagagttcctctacccagcaaaaatgagtgtctcagaagtgtgctcctctggcctcagttctcctcttttggaacaacataaaacaaatttaattttctacgcctctggggatatctgctcagccaatggaaaatctgggttcaaccagcccctgccatttcttaagactttctgctccactcacaggatcctgagctgcacttacctgtgagagtcttcaaacttttaaaccttgccagtcaggacttttgctattgcaaatagaaaacccaactcaacctgcttaagcagaaaataaatttattgattcaagtt

SEQ ID NO: 369705 - DNA, 1272 bp, Homo sapiens
agagggcccccaggtctcctgctggagcctccacgcagggggcctgtggggatggccagggctcagcccagcacctgagcgcccctcccaccagctgctctgccagaccgcatgctccgccccctgcaaacgaccgtggggagagcagcttgagtaagttccccttccgtttcctcctgccccaccaccgctgctcctcagcaggcgcctcaccagcctccacaccccttgcgcccgcagaaacgcgcctggccctgagctgtcaccaccgacactctccaggctccggacacgatgcaggccatcaagtgtgtggtggtgggagatggggccgtgggcaagacctgccttctcatcagctacaccaccaacgcctttcccggagagtacatccccaccgtgtttgacaactattcagccaatgtgatggtggacagcaagccagtgaacctggggctgtgggacactgctgggcaggaggactacgaccgtctccggccgctctcctatccacagacggacgtcttcctcatctgcttctccctcgtcagcccagcctcttatgagaacgtccgcgccaagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattgactcggtgaaatacctggagtgctcagctctcacccagagaggcctgaaaaccgtgttcgacgaggccatccgggccgtgctgtgccctcagcccacgcggcagcagaagcgcgcctgcagcctcctctaggggttgcaccccagcgctcccacctagatgggtctgatcctccaggatccccacccaaagcctgatggcaccccggctggccatgctgtcccctccctgtggcgtttcttagcagatggctgcagagcttcgttgatggtcttttctgtactggaggcctcctgaggccaggaacgtgcaaatttgcaggtgctgcatcccaagcccctcatgctcctgccttcctgagggccagaggggagccccaggacccttaagcacccggttctgcgtcgtgcactgcgctgtggagatctaccgtcctcagtccaccagctgattcccttggaaatgggccatgtgcgcccctggtcctcggggggggcttcccctgggcgggccaatgaggcccgcggagcc

SEQ ID NO: 369706 - DNA, 343 bp, Homo sapiens
tcagctcggacccactttcagagtagagagagttcctctacccagcaaaaatgagtgtctcagaagtgtgctcctctggcctcagttctcctcttttggaacaacataaaacaaatttaattttctacgcctctggggatatctgctcagccaatggaaaatctgggttcaaccagcccctgccatttcttaagactttctgctccactcacaggatcctgagctgcacttacctgtgagagtcttcaaacttttaaaccttgccagtcaggacttttgctattgcaaatagaaaacccaactcaacctgcttaagcagaaaataaatttattgattcaagtt

SEQ ID NO: 369707 - DNA, 916 bp, Homo sapiens
agagggcccccaggtctcctgctggagcctccacgcagggggcctgtggggatggccagggctcagcccagcacctgagcgcccctcccaccagctgctctgccagaccgcatgctccgccccctgcaaacgaccgtggggagagcagcttgagtaagttccccttccgtttcctcctgccccaccaccgctgctcctcagcaggcgcctcaccagcctccacaccccttgcgcccgcagaaacgcgcctggccctgagctgtcaccaccgacactctccaggctccggacacgatgcaggccatcaagtgtgtggtggtgggagatggggccgtgggcaagacctgccttctcatcagctacaccaccaacgcctttcccggagagtacatccccaccgtgtttgacaactattcagccaatgtgatggtggacagcaagccagtgaacctggggctgtgggacactgctgggcaggaggactacgaccgtctccggccgctctcctatccacagacggtgtgctgctcccacctgccttgcagtcctgacctttgctgtctctgttccctctgcttgggatgcccttccagccagctcagcctgggaaaccctacctctccccttaaggcccagctcagggagtctgcctgccttgcatgtcccaggcagagaagggcttcctcttgcactccctcagccctgcattggttcccggtcctcaatgtgcccatcttcccaccccattgcctcctgggctctggcaccccctgtttccagtggtggggcaggtggattctgcacagggccccaggaggcagcccagcatggtgagccctgggagtgctgggggaggggagaggtggaggatgcctgcaggtggctgctgggtcctcgcccttcctccagggtatgc

SEQ ID NO: 369708 - DNA, 1648 bp, Homo sapiens
agagggcccccaggtctcctgctggagcctccacgcagggggcctgtggggatggccagggctcagcccagcacctgagcgcccctcccaccagctgctctgccagaccgcatgctccgccccctgcaaacgaccgtggggagagcagcttgagtaagttccccttccgtttcctcctgccccaccaccgctgctcctcagcaggcgcctcaccagcctccacaccccttgcgcccgcagaaacgcgcctggccctgagctgtcaccaccgacactctccaggctccggacacgatgcaggccatcaagtgtgtggtggtgggagatggggccgtgggcaagacctgccttctcatcagctacaccaccaacgcctttcccggagagtacatccccaccgtgtttgacaactattcagccaatgtgatggtggacagcaagccagtgaacctggggctgtgggacactgctgggcaggaggactacgaccgtctccggccgctctcctatccacagacggacgtcttcctcatctgcttctccctcgtcagcccagcctcttatgagaacgtccgcgccaagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattgactcggtgaaatacctggagtgctcagctctcacccagagaggcctgaaaaccgtgttcgacgaggccatccgggccgtgctgtgccctcagcccacgcggcagcagaagcgcgcctgcagcctcctctaggggttgcaccccagcgctcccacctagatgggtctgatcctccaggatccccacccaaagcctgatggcaccccggctggccatgctgtcccctccctgtggcgtttcttagcagatggctgcagagcttcgttgatggtcttttctgtactggaggcctcctgaggccaggaacgtgcaaatttgcaggtgctgcatcccaagcccctcatgctcctgccttcctgagggccagaggggagccccaggacccattaagccacccccgtgttcctgccgtcagtgccaactgccgcatgtggaagcatctacccgttcactccagtcccaccccacgcctgactcccctctggaaactgcaggccagatggttgctgccacaacttgtgtaccttcagggatggggctcttactccctcctgaggccagctgctctaatatcgatggtcctgcttgccagagagttcctctacccagcaaaaatgagtgtctcagaagtgtgctcctctggcctcagttctcctcttttggaacaacataaaacaaatttaattttctacgcctctggggatatctgctcagccaatggaaaatctgggttcaaccagcccctgccatttcttaagactttctgctccactcacaggatcctgagctgcacttacctgtgagagtcttcaaacttttaaaccttgccagtcaggacttttgctattgcaaatagaaaacccaactcaacctgcttaagcagaaaataaatttattgattcaagtt

SEQ ID NO: 369709 - DNA, 1780 bp, Homo sapiens
  misc_feature (1650)..(1650): n is a, c, g, or t
agagggcccccaggtctcctgctggagcctccacgcagggggcctgtggggatggccagggctcagcccagcacctgagcgcccctcccaccagctgctctgccagaccgcatgctccgccccctgcaaacgaccgtggggagagcagcttgagtaagttccccttccgtttcctcctgccccaccaccgctgctcctcagcaggcgcctcaccagcctccacaccccttgcgcccgcagaaacgcgcctggccctgagctgtcaccaccgacactctccaggctccggacacgatgcaggccatcaagtgtgtggtggtgggagatggggccgtgggcaagacctgccttctcatcagctacaccaccaacgcctttcccggagagtacatccccaccgtgtttgacaactattcagccaatgtgatggtggacagcaagccagtgaacctggggctgtgggacactgctgggcaggaggactacgaccgtctccggccgctctcctatccacagacggacgtcttcctcatctgcttctccctcgtcagcccagcctcttatgagaacgtccgcgccaagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattgactcggtgaaatacctggagtgctcagctctcacccagagaggcctgaaaaccgtgttcgacgaggccatccgggccgtgctgtgccctcagcccacgcggcagcagaagcgcgcctgcagcctcctctaggggttgcaccccagcgctcccacctagatgggtctgatcctccaggatccccacccaaagcctgatggcaccccggctggccatgctgtcccctccctgtggcgtttcttagcagatggctgcagagcttcgttgatggtcttttctgtactggaggcctcctgaggccaggaacgtgcaaatttgcaggtgctgcatcccaagcccctcatgctcctgccttcctgagggccagaggggagccccaggacccattaagccacccccgtgttcctgccgtcagtgccaactgccgcatgtggaagcatctacccgttcactccagtcccaccccacgcctgactcccctctggaaactgcaggccagatggttgctgccacaacttgtgtaccttcagggatggggctcttactccctcctgaggccagctgctctaatatcgatggtcctgcttgccagagagttcctctacccagcaaaaatgagtgtctcagaagtgtgctcctctggcctcagttctcctcttttggaacaacataaaacaaatttaattttctacgcctctggggatatctgctcagccaatggaaaatctgggttcaaccagcccctgccatttcttaagactttctgctccactcacaggatcctgagctgcacttacctgtgagagtcttcaaacttttaaaccttgccagtcaggacttttgctattgcaaatagaaaacccaactcaacctgcttaagcagaaaataaatttattgattcaagttcncaaacaacaaatccagcacacatcgaaagcaaacaagaacacaatcacacaacaagggggggggcgccaaaaaaattccccgcggggcgcccatattagccacccccgttttttttaaaagagcgggcca

SEQ ID NO: 369710 - DNA, 1572 bp, Homo sapiens
agagggcccccaggtctcctgctggagcctccacgcagggggcctgtggggatggccagggctcagcccagcacctgagcgcccctcccaccagctgctctgccagaccgcatgctccgccccctgcaaacgaccgtggggagagcagcttgagtaagttccccttccgtttcctcctgccccaccaccgctgctcctcagcaggcgcctcaccagcctccacaccccttgcgcccgcagaaacgcgcctggccctgagctgtcaccaccgacactctccaggctccggacacgatgcaggccatcaagtgtgtggtggtgggagatggggccgtgggcaagacctgccttctcatcagctacaccaccaacgcctttcccggagagtacatccccaccgtgtttgacaactattcagccaatgtgatggtggacagcaagccagtgaacctggggctgtgggacactgctgggcaggaggactacgaccgtctccggccgctctcctatccacagacggacgtcttcctcatctgcttctccctcgtcagcccagcctcttatgagaacgtccgcgccaagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattgactcggtgaaatacctggagtgctcagctctcacccagagaggcctgaaaaccgtgttcgacgaggccatccgggccgtgctgtgccctcagcccacgcggcagcagaagcgcgcctgcagcctcctctaggggttgcaccccagcgctcccacctagatgggtctgatcctccaggatccccacccaaagcctgatggcaccccggctggccatgctgtcccctccctgtggcgtttcttagcagatggctgcagagcttcgttgatggtcttttctgtactggaggcctcctgaggccaggaacccattaagccacccccgtgttcctgccgtcagtgccaactgccgcatgtggaagcatctacccgttcactccagtcccaccccacgcctgactcccctctggaaactgcaggccagatggttgctgccacaacttgtgtaccttcagggatggggctcttactccctcctgaggccagctgctctaatatcgatggtcctgcttgccagagagttcctctacccagcaaaaatgagtgtctcagaagtgtgctcctctggcctcagttctcctcttttggaacaacataaaacaaatttaattttctacgcctctggggatatctgctcagccaatggaaaatctgggttcaaccagcccctgccatttcttaagactttctgctccactcacaggatcctgagctgcacttacctgtgagagtcttcaaacttttaaaccttgccagtcaggacttttgctattgcaaatagaaaacccaactcaacctgcttaagcagaaaataaatttattgattcaagtt

SEQ ID NO: 369711 - DNA, 1180 bp, Homo sapiens
tggcaacttgctgcctctcctctccctacaccctcacactccctctgatccccgcacagcctcgcgccccctcttgacccatacaaccttgtgtccccccacccacctgcccagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattgactcggtgaaatacctggagtgctcagctctcacccagagaggcctgaaaaccgtgttcgacgaggccatccgggccgtgctgtgccctcagcccacgcggcagcagaagcgcgcctgcagcctcctctaggggttgcaccccagcgctcccacctagatgggtctgatcctccaggatccccacccaaagcctgatggcaccccggctggccatgctgtcccctccctgtggcgtttcttagcagatggctgcagagcttcgttgatggtcttttctgtactggaggcctcctgaggccaggaacgtgcaaatttgcaggtgctgcatcccaagcccctcatgctcctgccttcctgagggccagaggggagccccaggacccattaagccacccccgtgttcctgccgtcagtgccaactgccgcatgtggaagcatctacccgttcactccagtcccaccccacgcctgactcccctctggaaactgcaggccagatggttgctgccacaacttgtgtaccttcagggatggggctcttactccctcctgaggccagctgctctaatatcgatggtcctgcttgccagagagttcctctacccagcaaaaatgagtgtctcagaagtgtgctcctctggcctcagttctcctcttttggaacaacataaaacaaatttaattttctacgcctctggggatatctgctcagccaatggaaaatctgggttcaaccagcccctgccatttcttaagactttctgctccactcacaggatcctgagctgcacttacctgtgagagtcttcaaacttttaaaccttgccagtcaggacttttgctattgcaaatagaaaacccaactcaacctgcttaagcagaaaataaatttattgattcaagtt

SEQ ID NO: 369712 - DNA, 1087 bp, Homo sapiens
agagggcccccaggtctcctgctggagcctccacgcagggggcctgtggggatggccagggctcagcccagcacctgagcgcccctcccaccagctgctctgccagaccgcatgctccgccccctgcaaacgaccgtggggagagcagcttgagtaagttccccttccgtttcctcctgccccaccaccgctgctcctcagcaggcgcctcaccagcctccacaccccttgcgcccgcagaaacgcgcctggccctgagctgtcaccaccgacactctccaggctccggacacgatgcaggccatcaagtgtgtggtggtgggagatggggccgtgggcaagacctgccttctcatcagctacaccaccaacgcctttcccggagagtacatccccaccgtgtttgacaactattcagccaatgtgatggtggacagcaagccagtgaacctggggctgtgggacactgctgggcaggaggactacgaccgtctccggccgctctcctatccacagacggacgtcttcctcatctgcttctccctcgtcagcccagcctcttatgagaacgtccgcgccaagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattgactcggtgaaatacctggagtgctcagctctcacccagagaggcctgaaaaccgtgttcgacgaggccatccgggccgtgctgtgccctcagcccacgcggcagcagaagcgcgcctgcagcctcctctaggggttgcaccccagcgctcccacctagatgggtctgatccgccgccgccccaggcccgcgggctgctgacagagatacgcgccgtggtgcgcacggagcccttcacgggacgctacagcctgtgccgggccgggagctgggcagggggaaattagcagtggtgagaaaatgtataaagatagattctgggaaagaatttgctgcaaagttcatg

SEQ ID NO: 369713 - DNA, 2336 bp, Homo sapiens
cgcccttctgacccaccccgctaggtagtcccacacggcggccctcggctcccgggccccgccccggcctcctgcatttgcccgaggccccctccccagcactggccacaccccagggtagccccgcccccagagctcctcccccagcggccggggtagggtggcggctggcccagccgggcccccgctgccctctgccctgggcgcttggtcggagcgggctgggcaaagcgggacagggcgagcgcggcggcccgggggctcggaggcgaagatggcgtccggcaggcgcgccccgcgcaccgggctgctggagctgcgcgccggggcgggctcgggggccggcggcgagcgatggcagcgggtgctgctgagtctggcggaggacgtgctgaccgtgagccccgccgacggcgaccctggtcccgagcccggcgctccgcgggagcaggagcccgcgcagctcaacggcgccgcggagccgggcgccgggcccccgcagctgccagaggcgctactgctccagcggcgccgcgtgacggtgcgcaaggccgacgccggtgggctgggcatcagcatcaaaggcggccgggagaacaagatgcctattctcatttccaagatcttcaagggattggcagctgaccagacagaggccctttttgtgggggatgccatcctgtctgtgaatggggaagacttgtcctctgctacccatgatgaggcggtgcaggtcctcaagaagacaggcaaggaggtggtgctggaggtcaagtatatgaaggacgtctcaccgtatttcaagaactctactggtgggacctcggtcggctgggactcacctcctgcctcaccccttcagcggcagccttcctcccctggccccacaccccggaacttcagcgaggccaaacacatgtccttgaagatggcatatgtctcgaagaggtgcacccccaatgacccggagcccaggtatctggagatctgctcggcagatggtcaagacaccctcttcctgagggccaaggatgaggctagtgcgaggtcgtgggcgactgccatccaagcccaggtcaatactctgacgccgcgggtcaaggatgagctgcaggcactgttggcagccaccagcacagctgggagccaggacatcaagcagattggctggctaactgagcagctgcccagtgggggcacagcccccaccctggccctgctaactgaaaaggaactgctcctctacttgtctctccccgagacccgcgaggccctgagccggccagcccgtactgccccactcatcgccaccagactggtgcactcaggcccctccaagggctcagtgccctacgatgcagagctctcttttgccctgcgcacgggcacgcgtcacggtgtggacactcacctgttcagcgtggagtcaccgcaggagctggctgcctggacccgccagcttgtggatggctgtcaccgggccgccgagggtgtgcaggaggtgtctacagcctgcacgtggaatgggcgtccctgcagcctgtctgtgcacatcgacaagggcttcacactgtgggcggctgagccaggtgcagcccgagctgtgctcctgcgacagcccttcgagaagctgcagatgtcttcagatgacggtgccagtctccttttcctggattttggaggtgctgaaggcgagatccagctggacctgcactcgtgtcccaaaaccatagtcttcatcatccactccttcctgtcggccaaagtcacccgcctcgggctgttggcctagaagtcgccggatgcactagccctgaagaggggtgtccatgacatggcctgagctgggcctccaccgactgcctgctcacccctgggctgagggaagggagaggagaggaacaagggcctccgaaaccccaaccctgagggagactggattggtcttggggcccaggacccagacgcaggacagagtggactctgcctgtgatggggtggccttcctgctgcccccctccaccagtgccttttgcagagagatattttgtgtacacagaagccattccgagtctgggacctgcccctgtgcggatcctgaccccagccaacagctgagctgccgggcctcctcgaggcccctaagccacccccagaggtcccatctgaagctggagtaccctggggtcagcagcaagagaaagaagaggagattttctgtttgtttttcccctcagccctgccaccgtggggagtctggtttttctcttcatcctgtctctctcctccttactcttggataaataaacagcctgtgagcacacaggcagcccggc

SEQ ID NO: 369714 - DNA, 1004 bp, Homo sapiens
  misc_feature (513)..(513): n is a, c, g, or t
  misc_feature (851)..(851): n is a, c, g, or t
cgcccttctgacccaccccgctaggtagtcccacacggcggccctcggctcccgggccccgccccggcctcctgcatttgcccgaggccccctccccagcactggccacaccccagggtagccccgcccccagagctcctcccccagcggccggggtagggtggcggctggcccagccgggcccccgctgccctctgccctgggcgcttggtcggagcgggctgggcaaagcgggacagggcgagcgcggcggcccgggggctcggaggcgaagatggcgtccggcaggcgcgccccgcgcaccgggctgctggagctgcgcgccggggcgggctcgggggccggcggcgagcgatggcagcgggtgctgctgagtctggcggaggacgtgctgaccgtgagccccgccgacggcgaccctggtcccgagcccggcgctccgcgggagcaggagcccgcgcagctcaacggcgccgcggactcagagcggccaatcccgcgcgtagcaatgantaggcgctgacaactgccatcaagcgcgcacttaatcgaagactgcgatgatcaacggcgaaaatgctaaagagacatgcgacgatcaaccggggcaataatgagatggaacgacgcaagaacgatcagaagccgattcaggtgacaaaataaaattggggcggaccagagcagaaatccctaatcaacatgatggaaggtggcactatacaaaaatgaaattgaattaatcggatgccacagttaactccgaatacagtgtatttgatcggttactcactaccagaatacatgccgagaagttaagggctgacaggtcacaaaagggttgaacgtgnacgcgctcggactcaccgctaatcgcaagccggggatttagccgctatcctggcgaatactcatgcgatcgatccaaaccccagtctcgactggcatgccgctccagactccagtatcccagttgtagccgcaaactgagcacgattgcaggc

SEQ ID NO: 369715 - DNA, 2871 bp, Homo sapiens
cgcccttctgacccaccccgctaggtagtcccacacggcggccctcggctcccgggccccgccccggcctcctgcatttgcccgaggccccctccccagcactggccacaccccagggtagccccgcccccagagctcctcccccagcggccggggtagggtggcggctggcccagccgggcccccgctgccctctgccctgggcgcttggtcggagcgggctgggcaaagcgggacagggcgagcgcggcggcccgggggctcggaggcgaagatggcgtccggcaggcgcgccccgcgcaccgggctgctggagctgcgcgccggggcgggctcgggggccggcggcgagcgatggcagcgggtgctgctgagtctggcggaggacgtgctgaccgtgagccccgccgacggcgaccctggtcccgagcccggcgctccgcgggagcaggagcccgcgcagctcaacggcgccgcggagccgggcgccgggcccccgcagctgccagaggcgctactgctccagcggcgccgcgtgacggtgcgcaaggccgacgccggtgggctgggcatcagcatcaaaggcggccgggagaacaagatgcctattctcatttccaagatcttcaagggattggcagctgaccagacagaggccctttttgtgggggatgccatcctgtctgtgaatggggaagacttgtcctctgctacccatgatgaggcggtgcaggtcctcaagaagacaggcaaggaggtggtgctggaggtcaagtatatgaaggacgtctcaccgtatttcaagaactctactggtgggacctcggtcggctgggactcacctcctgcctcaccccttcagcggcagccttcctcccctggccccacaccccggaacttcagcgaggccaaacacatgtccttgaagatggcatatgtctcgaagaggtgcacccccaatgacccggagcccaggtatctggagatctgctcggcagatggtcaagacaccctcttcctgagggccaaggatgaggctagtgcgaggtcgtgggcgactgccatccaagcccaggtcaatactctgacgccgcgggtcaaggatgagctgcaggcactgttggcagccaccagcacagctgggagccaggacatcaagcagattggctggctaactgagcagctgcccagtgggggcacagcccccaccctggccctgctaactgaaaaggaactgctcctctacttgtctctccccgagacccgcgaggccctgagccggccagcccgtactgccccactcatcgccaccagactggtgcactcaggcccctccaagggctcagtgccctacgatgcagagctctcttttgccctgcgcacgggcacgcgtcacggtgtggacactcacctgttcagcgtggagtcaccgcaggagctggctgcctggacccgccagcttgtggatggctgtcaccgggccgccgagggtgtgcaggaggtgtctacagcctgcacgtggaatgggcgtccctgcagcctgtctgtgcacatcgacaagggcttcacactgtgggcggctgagccaggtgcagcccgagctgtgctcctgcgacagcccttcgagaagctgcagatgtcttcagatgacggtgccagtctccttttcctggattttggaggtgctgaaggcgagatccagctggacctgcactcgtgtcccaaaaccatagtcttcatcatccactccttcctgtcggccaaagtcacccgcctcgggctgttggcctagaagtcgccggatgcactagccctgaagaggggtgtccatgacatggcctgagctgggcctccaccgactgcctgctcacccctgggctgagggaagggagaggagaggaacaagggcctccgaaaccccaaccctgagggagactggattggtcttggggcccaggacccagacgcaggacagagtggactctgcctgtgatggggtggccttcctgctgcccccctccaccagtgccttttgcagagagatattttgtgtacacagaagccattccgagtctgggacctgcccctgtgcggatcctgaccccagccaacagctgagctgccgggcctcctcgaggcccctaagccacccccagaggtcccatctgaagctggagtaccctggggtcagcagcaagagaaagaagaggagattttctgtttgtttttcccctcagccctgccaccgtggggagtctggtttttctcttcatcctgtctctctcctccttactcttggataaataaacagcctgtgagcacacaggcagcccggcccagtgtatgtggtctgtgccttggcctttgggtcctggggtggcccctgcagtcccaagatggaccagaccaaggactagggcacctttccctggagaagaacagacctttactacatgggccaaagacagtgtattggttatctattgttgtgtgacaaattatccaaaatttgcagcttaaaatgacaaatattcattatctcttaggttctgtgggtcagaaatttgagaggggctaagctgggctgttcttgtctcagggtcgctcatgaggttgcagtcaagttgtcggctagggctgcagtcatctgaaggcttgactggggctggaggatccattccaatactgctcatgcacatggctgtgggtaggaggtctcagttcctcaccatgtagggctaaccctagagctgctgcttgagttttctcatgatatggcagttggctttccccacagtgagacagaagagagggcaaggaggaagccacaaacagtgcctcttatgacccggtcttggaagccttacactg

SEQ ID NO: 369716 - DNA, 2368 bp, Homo sapiens
cgcccttctgacccaccccgctaggtagtcccacacggcggccctcggctcccgggccccgccccggcctcctgcatttgcccgaggccccctccccagcactggccacaccccagggtagccccgcccccagagctcctcccccagcggccggggtagggtggcggctggcccagccgggcccccgctgccctctgccctgggcgcttggtcggagcgggctgggcaaagcgggacagggcgagcgcggcggcccgggggctcggaggcgaagatggcgtccggcaggcgcgccccgcgcaccgggctgctggagctgcgcgccggggcgggctcgggggccggcggcgagcgatggcagcgggtgctgctgagtctggcggaggacgtgctgaccgtgagccccgccgacggcgaccctggtcccgagcccggcgctccgcgggagcaggagcccgcgcagctcaacggcgccgcggagccgggcgccgggcccccgcagctgccagaggcgctactgctccagcggcgccgcgtgacggtgcgcaaggccgacgccggtgggctgggcatcagcatcaaaggcggccgggagaacaagatgcctattctcatttccaagatcttcaagggattggcagctgaccagacagaggccctttttgtgggggatgccatcctgtctgtgaatggggaagacttgtcctctgctacccatgatgaggcggtgcaggtcctcaagaagacaggcaaggaggtggtgctggaggtcaagtatatgaaggacgtctcaccgtatttcaagaactctactggtgggacctcggtcggctgggactcacctcctgcctcaccccttcagcggcagccttcctcccctggccccacaccccggaacttcagcgaggccaaacacatgtccttgaagatggcatatgtctcgaagaggtgcacccccaatgacccggagcccaggtatctggagatctgctcggcagatggtcaagacaccctcttcctgagggccaaggatgaggctagtgcgaggtcgtgggcgactgccatccaagcccaggtcaatactctgacgccgcgggtcaaggatgagctgcaggcactgttggcagccaccagcacagctgggagccaggacatcaagcagattggctggctaactgagcagctgcccagtgggggcacagcccccaccctggccctgctaactgaaaaggaactgctcctctacttgtctctccccgagacccgcgaggccctgagccggccagcccgtactgccccactcatcgccaccagactggtgcactcaggcccctccaagggctcagtgccctacgatgcagagctctcttttgccctgcgcacgggcacgcgtcacggtgtggacactcacctgttcagcgtggagtcaccgcaggagctggctgcctggacccgccagcttgtggatggctgtcaccgggccgccgagggtgtgcaggaggtgtctacaggtgtgctgggaggatctgggagtgtccctctgcctgcacgtggaatgggcgtccctgcagcctgtctgtgcacatcgacaagggcttcacactgtgggcggctgagccaggtgcagcccgagctgtgctcctgcgacagcccttcgagaagctgcagatgtcttcagatgacggtgccagtctccttttcctggattttggaggtgctgaaggcgagatccagctggacctgcactcgtgtcccaaaaccatagtcttcatcatccactccttcctgtcggccaaagtcacccgcctcgggctgttggcctagaagtcgccggatgcactagccctgaagaggggtgtccatgacatggcctgagctgggcctccaccgactgcctgctcacccctgggctgagggaagggagaggagaggaacaagggcctccgaaaccccaaccctgagggagactggattggtcttggggcccaggacccagacgcaggacagagtggactctgcctgtgatggggtggccttcctgctgcccccctccaccagtgccttttgcagagagatattttgtgtacacagaagccattccgagtctgggacctgcccctgtgcggatcctgaccccagccaacagctgagctgccgggcctcctcgaggcccctaagccacccccagaggtcccatctgaagctggagtaccctggggtcagcagcaagagaaagaagaggagattttctgtttgtttttcccctcagccctgccaccgtggggagtctggtttttctcttcatcctgtctctctcctccttactcttggataaataaacagcctgtgagcacacaggcagcccggc

SEQ ID NO: 369717 - DNA, 2289 bp, Homo sapiens
cgcccttctgacccaccccgctaggtagtcccacacggcggccctcggctcccgggccccgccccggcctcctgcatttgcccgaggccccctccccagcactggccacaccccagggtagccccgcccccagagctcctcccccagcggccggggtagggtggcggctggcccagccgggcccccgctgccctctgccctgggcgcttggtcggagcgggctgggcaaagcgggacagggcgagcgcggcggcccgggggctcggaggcgaagatggcgtccggcaggcgcgccccgcgcaccgggctgctggagctgcgcgccggggcgggctcgggggccggcggcgagcgatggcagcgggtgctgctgagtctggcggaggacgtgctgaccgtgagccccgccgacggcgaccctggtcccgagcccggcgctccgcgggagcaggagcccgcgcagctcaacggcgccgcggagccgggcgccgggcccccgcagctgccagaggcgctactgctccagcggcgccgcgtgacggtgcgcaaggccgacgccggtgggctgggcatcagcatcaaaggcggccgggagaacaagatgcctattctcatttccaagatcttcaagggattggcagctgaccagacagaggccctttttgtgggggatgccatcctgtctgtgaatggggaagacttgtcctctgctacccatgatgaggcggtgcaggtcctcaagaagacaggcaaggaggtggtgctggaggtcaagtatatgaaggacgtctcaccgtatttcaagaactctactggtgggacctcggtcggctgggactcacctcctgcctcaccccttcagcggcagccttcctcccctggccccacaccccggaacttcagcgaggccaaacacatgtccttgaagatggcatatgtctcgaagaggtgcacccccaatgacccggagcccaggtatctggagatctgctcggcagatggtcaagacaccctcttcctgagggccaaggatgaggctagtgcgaggtcgtgggcgactgccatccaagcccaggtcaatactctgacgccgcgggtcaaggatgagctgcaggcactgttggcagccaccagcacagctgggagccaggacatcaagcagattggctggctaactgagcagctgcccagtgggggcacagcccccaccctggccctgctaactgaaaaggaactgctcctctacttgtctctccccgagacccgcgaggccctgagccggccagcccgtactgccccactcatcgccaccagactggtgcactcaggcccctccaagggctcagtgccctacgatgcagagctctcttttgccctgcgcacgggcacgcgtcacggtgtggacactcacctgttcagcgtggagtcaccgcaggagctggctgcctggacccgccagcttgtggatggctgtcaccgggccgccgagggtgtgcaggaggtgtctacagcctgcacgtggaatgggcgtccctgcagcctgtctgtcccgagctgtgctcctgcgacagcccttcgagaagctgcagatgtcttcagatgacggtgccagtctccttttcctggattttggaggtgctgaaggcgagatccagctggacctgcactcgtgtcccaaaaccatagtcttcatcatccactccttcctgtcggccaaagtcacccgcctcgggctgttggcctagaagtcgccggatgcactagccctgaagaggggtgtccatgacatggcctgagctgggcctccaccgactgcctgctcacccctgggctgagggaagggagaggagaggaacaagggcctccgaaaccccaaccctgagggagactggattggtcttggggcccaggacccagacgcaggacagagtggactctgcctgtgatggggtggccttcctgctgcccccctccaccagtgccttttgcagagagatattttgtgtacacagaagccattccgagtctgggacctgcccctgtgcggatcctgaccccagccaacagctgagctgccgggcctcctcgaggcccctaagccacccccagaggtcccatctgaagctggagtaccctggggtcagcagcaagagaaagaagaggagattttctgtttgtttttcccctcagccctgccaccgtggggagtctggtttttctcttcatcctgtctctctcctccttactcttggataaataaacagcctgtgagcacacaggcagcccggc

SEQ ID NO: 369718 - DNA, 1049 bp, Homo sapiens
aaccttacggcttaggtacgaggcctgactggtgcactcaggcccctccaagggctcagtgccctacgatgcagagctctcttttgccctgcgcacgggcacgcgtcacggtgtggacactcacctgttcagcgtggagtcaccgcaggagctggctgcctggacccgccagcttgtggatggctgtcaccgggccgccgagggtgtgcaggaggtgtctacagcctgcacgtggaatgggcgtccctgcagcctgtctgtgcacatcgacaagggcttcacactgtgggcggctgagccaggtgcagcccgagctgtgctcctgcgacagcccttcgagaagctgcagatgtcttcagatgacggtgccagtctccttttcctggattttggaggtgctgaaggcgagatccagctggacctgcactcgtgtcccaaaaccatagtcttcatcatccactccttcctgtcggccaaagtcacccgcctcgggctgttggcctagaagtcgccggatgcactagccctgaagaggggtgtccatgacatggcctgagctgggcctccaccgactgcctgctcacccctgggctgagggaagggagaggagaggaacaagggcctccgaaaccccaaccctgagggagactggattggtcttggggcccaggacccagacgcaggacagagtggactctgcctgtgatggggtggccttcctgctgcccccctccaccagtgccttttgcagagagatattttgtgtacacagaagccattccgagtctgggacctgcccctgtgcggatcctgaccccagccaacagctgagctgccgggcctcctcgaggcccctaagccacccccagaggtcccatctgaagctggagtaccctggggtcagcagcaagagaaagaagaggagattttctgtttgtttttcccctcagccctgccaccgtggggagtctggtttttctcttcatcctgtctctctcctccttactcttggataaataaacagcctgtgagcacacaggcagcccggc

SEQ ID NO: 369719 - DNA, 1322 bp, Homo sapiens
tgagccgtgcagataatcagggaagcatgtataggcagagggaagagcatatgcaaaggtgctgaggcaggcatgtgctaggtgtgtgtgatgacaccagtatagccagagccaagggagtgacggggagggtggcaggagatgtctcctgctgagtcaatcagtgccccctggcaagtcctgtcctgttaggtggtaaaggatttacagggtttcttcccaggtcactggcccctttgcccagaactatttgcctccggcctgaggcctcatgctcagccctctgcccccaacccccagactggtgcactcaggcccctccaagggctcagtgccctacgatgcagagctctcttttgccctgcgcacgggcacgcgtcacggtgtggacactcacctgttcagcgtggagtcaccgcaggagctggctgcctggacccgccagcttgtggatggctgtcaccgggccgccgagggtgtgcaggaggtgtctacagcctgcacgtggaatgggcgtccctgcagcctgtctgtgcacatcgacaagggcttcacactgtgggcggctgagccaggtgcagcccgagctgtgctcctgcgacagcccttcgagaagctgcagatgtcttcagatgacggtgccagtctccttttcctggattttggaggtgctgaaggcgagatccagctggacctgcactcgtgtcccaaaaccatagtcttcatcatccactccttcctgtcggccaaagtcacccgcctcgggctgttggcctagaagtcgccggatgcactagccctgaagaggggtgtccatgacatggcctgagctgggcctccaccgactgcctgctcacccctgggctgagggaagggagaggagaggaacaagggcctccgaaaccccaaccctgagggagactggattggtcttggggcccaggacccagacgcaggacagagtggactctgcctgtgatggggtggccttcctgctgcccccctccaccagtgccttttgcagagagatattttgtgtacacagaagccattccgagtctgggacctgcccctgtgcggatcctgaccccagccaacagctgagctgccgggcctcctcgaggcccctaagccacccccagaggtcccatctgaagctggagtaccctggggtcagcagcaagagaaagaagaggagattttctgtttgtttttcccctcagccctgccaccgtggggagtctggtttttctcttcatcctgtctctctcctccttactcttggataaataaacagcctgtgagcacacaggcagcccggc

SEQ ID NO: 369720 - DNA, 304 bp, Homo sapiens
gctccccctttctacttgtgctgctggaagtgggactggaagtgggtgtaggtcctctgagggtgggggtgatgactctctgcagggtgggtgtactggtgccacgacaaacagtgagcctcccatccctggaggcattcaggccccactttgtaagctgcggtgggggttggaggttggggtgtagtctctgaggtgccagctgtgcctgtacctatgtgccctccctgcagcctgcacgtggaatgggcgtccctgcagcctgtctgtgcacatcgacaagggcttcacactgtgggcggct

SEQ ID NO: 369721 - DNA, 2592 bp, Homo sapiens
cgcccttctgacccaccccgctaggtagtcccacacggcggccctcggctcccgggccccgccccggcctcctgcatttgcccgaggccccctccccagcactggccacaccccagggtagccccgcccccagagctcctcccccagcggccggggtagggtggcggctggcccagccgggcccccgctgccctctgccctgggcgcttggtcggagcgggctgggcaaagcgggacagggcgagcgcggcggcccgggggctcggaggcgaagatggcgtccggcaggcgcgccccgcgcaccgggctgctggagctgcgcgccggggcgggctcgggggccggcggcgagcgatggcagcgggtgctgctgagtctggcggaggacgtgctgaccgtgagccccgccgacggcgaccctggtcccgagcccggcgctccgcgggagcaggagcccgcgcagctcaacggcgccgcggagccgggcgccgggcccccgcagctgccagaggcgctactgctccagcggcgccgcgtgacggtgcgcaaggccgacgccggtgggctgggcatcagcatcaaaggcggccgggagaacaagatgcctattctcatttccaagatcttcaagggattggcagctgaccagacagaggccctttttgtgggggatgccatcctgtctgtgaatggggaagacttgtcctctgctacccatgatgaggcggtgcaggtcctcaagaagacaggcaaggaggtggtgctggaggtcaagtatatgaaggacgtctcaccgtatttcaagaactctactggtgggacctcggtcggctgggactcacctcctgcctcaccccttcagcggcagccttcctcccctggccccacaccccggaacttcagcgaggccaaacacatgtccttgaagatggcatatgtctcgaagaggtgcacccccaatgacccggagcccaggtatctggagatctgctcggcagatggtcaagacaccctcttcctgagggccaaggatgaggctagtgcgaggtcgtgggcgactgccatccaagcccaggtcaatactctgacgccgcgggtcaaggatgagctgcaggcactgttggcagccaccagcacagctgggagccaggacatcaagcagattggctggctaactgagcagctgcccagtgggggcacagcccccaccctggccctgctaactgaaaaggaactgctcctctacttgtctctccccgagacccgcgaggccctgagccggccagcccgtactgccccactcatcgccaccagactggtgcactcaggcccctccaagggctcagtgccctacgatgcagagctctcttttgccctgcgcacgggcacgcgtcacggtgtggacactcacctgttcagcgtggagtcaccgcaggagctggctgcctggacccgccagcttgtggatggctgtcaccgggccgccgagggtgtgcaggaggtgtctacagcctgcacgtggaatgggcgtccctgcagcctgtctgtgcacatcgacaagggcttcacactgtgggcggctgagccaggtgcagcccgagctgtgctcctgcgacagcccttcgagaagctgcagatgtcttcagatgacggtgccagtctccttttcctggattttggaggtgctgaaggcgagatccagctggacctgcactcgtgtcccaaaaccatagtcttcatcatccactccttcctgtcggccaaagtcacccgcctcgggctgttggcctagaagtcgccggatgcactagccctgaagaggggtgtccatgacatggcctgagctgggcctccaccgactgcctgctcacccctgggctgagggaagggagaggagaggaacaagggcctccgaaaccccaaccctgagggagactggattggtcttggggcccaggacccagacgcaggacagagtggactctgcctgtgatggggtggccttcctgctgcccccctccaccagtgccttttgcagagagatattttgtgtacacagaagccattccgagtctgggacctgcccctgtgcggatcctgaccccagccaacagctgagctgccgggcctcctcgaggcccctaagccacccccagaggtcccatctgaagctggagtaccctggggtcagcagcaagagaaagaagaggagattttctgtttgtttttcccctcagccctgccaccgtggggagtctggtttttctcttcatcctgtctctctcctccttactcttggataaataaacagcctgtgagcacacaggcagcccggcaacaaatcaccgagcgccacgacagaaaggacgcattacctcacgcactcgcagagaaccacacaaaagagcggccggcgactagcgacgacagcgagcgcacaattcaccgacacaccatagtatagccagagcgccccagagagagggaaaaaagaaaacagcgcacataaaaaggtgcagtggaaaacaaaggcatcggaaagcccccttggcgggactgcgacacacagaacgccgcgctacccgatgacgg

SEQ ID NO: 369722 - DNA, 1448 bp, Homo sapiens
  misc_feature (68)..(68): n is a, c, g, or t
  misc_feature (73)..(73): n is a, c, g, or t
caacaaaaacaaccacaccacaaaccaagctattgaaactatcggctaggtcgaggccgcgttgttantcggncgaggcggagccaggtatctggagatctgctcggcagatggtcaagacaccctcttcctgagggccaaggatgaggctagtgcgaggtcgtgggcgactgccatccaagcccaggtcaatactctgacgccgcgggtcaaggatgagctgcaggcactgttggcagccaccagcacagctgggagccaggacatcaagcagattggctggctaactgagcagctgcccagtgggggcacagcccccaccctggccctgctaactgaaaaggaactgctcctctacttgtctctccccgagacccgcgaggccctgagccggccagcccgtactgccccactcatcgccaccagactggtgcactcaggcccctccaagggctcagtgccctacgatgcagagctctcttttgccctgcgcacgggcacgcgtcacggtgtggacactcacctgttcagcgtggagtcaccgcaggagctggctgcctggacccgccagcttgtggatggctgtcaccgggccgccgagggtgtgcaggaggtgtctacagcctgcacgtggaatgggcgtccctgcagcctgtctgtgcacatcgacaagggcttcacactgtgggcggctgagccaggtgcagcccgagctgtgctcctgcgacagcccttcgagaagctgcagatgtcttcagatgacggtgccagtctccttttcctggattttggaggtgctgaaggcgagatccagctggacctgcactcgtgtcccaaaaccatagtcttcatcatccactccttcctgtcggccaaagtcacccgcctcgggctgttggcctagaagtcgccggatgcactagccctgaagaggggtgtccatgacatggcctgagctgggcctccaccgactgcctgctcacccctgggctgagggaagggagaggagaggaacaagggcctccgaaaccccaaccctgagggagactggattggtcttggggcccaggacccagacgcaggacagagtggactctgcctgtgatggggtggccttcctgctgcccccctccaccagtgccttttgcagagagatattttgtgtacacagaagccattccgagtctgggacctgcccctgtgcggatcctgaccccagccaacagctgagctgccgggcctcctcgaggcccctaagccacccccagaggtcccatctgaagctggagtaccctggggtcagcagcaagagaaagaagaggagattttctgtttgtttttcccctcagccctgccaccgtggggagtctggtttttctcttcatcctgtctctctcctccttactcttggataaataaacagcctgtgagcacacaggcagcccggc

SEQ ID NO: 369723 - DNA, 2249 bp, Homo sapiens
cgcccttctgacccaccccgctaggtagtcccacacggcggccctcggctcccgggccccgccccggcctcctgcatttgcccgaggccccctccccagcactggccacaccccagggtagccccgcccccagagctcctcccccagcggccggggtagggtggcggctggcccagccgggcccccgctgccctctgccctgggcgcttggtcggagcgggctgggcaaagcgggacagggcgagcgcggcggcccgggggctcggaggcgaagatggcgtccggcaggcgcgccccgcgcaccgggctgctggagctgcgcgccggggcgggctcgggggccggcggcgagcgatggcagcgggtgctgctgagtctggcggaggacgtgctgaccgtgagccccgccgacggcgaccctggtcccgagcccggcgctccgcgggagcaggagcccgcgcagctcaacggcgccgcggagccgggcgccgggcccccgcagctgccagaggcgctactgctccagcggcgccgcgtgacggtgcgcaaggccgacgccggtgggctgggcatcagcatcaaaggcggccgggagaacaagatgcctattctcatttccaagatcttcaagggattggcagctgaccagacagaggccctttttgtgggggatgccatcctgtctgtgaatggggaagacttgtcctctgctacccatgatgaggcggtgcaggtcctcaagaagacaggcaaggaggtggtgctggaggtcaagtatatgaaggacgtctcaccgtatttcaagaactctactggtgggacctcggtcggctgggactcacctcctgcctcaccccttcagcggcagccttcctcccctggccccacaccccggaacttcagcgaggccaaacacatgtccttgaagatggcatatgtctcgaagaggtgcacccccaatgacccggagcccaggtatctggagatctgctcggcagatggtcaagacaccctcttcctgagggccaaggatgaggctagtgcgaggtcgtgggcgactgccatccaagcccaggtcaatactctgacgccgcgggtcaaggatgagctgcaggcactgttggcagccaccagcacagctgggagccaggacatcaagcagattggctggctaactgagcagctgcccagtgggggcacagcccccaccctggccctgctaactgaaaaggaactgctcctctacttgtctctccccgagacccgcgaggccctgagccggccagcccgtactgccccactcatcgccaccaggtacccacaggcaggggcagtatgtctcccccagaacttgccaggagatgctccagcagggccccagaagctgggaactccagccctgtccaccctcagctattccccagcctgcacgtggaatgggcgtccctgcagcctgtctgtgcacatcgacaagggcttcacactgtgggcggctgagccaggtgcagcccgagctgtgctcctgcgacagcccttcgagaagctgcagatgtcttcagatgacggtgccagtctccttttcctggattttggaggtgctgaaggcgagatccagctggacctgcactcgtgtcccaaaaccatagtcttcatcatccactccttcctgtcggccaaagtcacccgcctcgggctgttggcctagaagtcgccggatgcactagccctgaagaggggtgtccatgacatggcctgagctgggcctccaccgactgcctgctcacccctgggctgagggaagggagaggagaggaacaagggcctccgaaaccccaaccctgagggagactggattggtcttggggcccaggacccagacgcaggacagagtggactctgcctgtgatggggtggccttcctgctgcccccctccaccagtgccttttgcagagagatattttgtgtacacagaagccattccgagtctgggacctgcccctgtgcggatcctgaccccagccaacagctgagctgccgggcctcctcgaggcccctaagccacccccagaggtcccatctgaagctggagtaccctggggtcagcagcaagagaaagaagaggagattttctgtttgtttttcccctcagccctgccaccgtggggagtctggtttttctcttcatcctgtctctctcctccttactcttggataaataaacagcctgtgagcacacaggcagcccggc

SEQ ID NO: 369724 - DNA, 2133 bp, Homo sapiens
cgcccttctgacccaccccgctaggtagtcccacacggcggccctcggctcccgggccccgccccggcctcctgcatttgcccgaggccccctccccagcactggccacaccccagggtagccccgcccccagagctcctcccccagcggccggggtagggtggcggctggcccagccgggcccccgctgccctctgccctgggcgcttggtcggagcgggctgggcaaagcgggacagggcgagcgcggcggcccgggggctcggaggcgaagatggcgtccggcaggcgcgccccgcgcaccgggctgctggagctgcgcgccggggcgggctcgggggccggcggcgagcgatggcagcgggtgctgctgagtctggcggaggacgtgctgaccgtgagccccgccgacggcgaccctggtcccgagcccggcgctccgcgggagcaggagcccgcgcagctcaacggcgccgcggagccgggcgccgggcccccgcagctgccagaggcgctactgctccagcggcgccgcgtgacggtgcgcaaggccgacgccggtgggctgggcatcagcatcaaaggcggccgggagaacaagatgcctattctcatttccaagatcttcaagggattggcagctgaccagacagaggccctttttgtgggggatgccatcctgtctgtgaatggggaagacttgtcctctgctacccatgatgaggcggtgcaggtcctcaagaagacaggcaaggaggtggtgctggaggtcaagtatatgaaggacgtctcaccgtatttcaagaactctactggtgggacctcggtcggctgggactcacctcctgcctcaccccttcagcggcagccttcctcccctggccccacaccccggaacttcagcgaggccaaacacatgtccttgaagatggcatatgtctcgaagaggtgcacccccaatgacccggagcccaggtatctggagatctgctcggcagatggtcaagacaccctcttcctgagggccaaggatgaggctagtgcgaggtcgtgggcgactgccatccaagcccaggtcaatactctgacgccgcgggtcaaggatgagctgcaggcactgttggcagccaccagcacagctgggagccaggacatcaagcagattggctggctaactgagcagctgcccagtgggggcacagcccccaccctggccctgctaactgaaaaggaactgctcctctacttgtctctccccgagacccgcgaggccctgagccggccagcccgtactgccccactcatcgccaccagactggtgcactcaggcccctccaagggctcagtgccctacgatgcagagctctcttttgccctgcgcacgggcacgcgtcacggtgtggacactcacctgttcagcgtggagtcaccgcaggagctggctgcctggacccgccagcttgtggatggctgtcaccgggccgccgagggtgtgcaggaggtgtctacagcctgcacgtggaatgggcgtccctgcagcctgtctgtgcacatcgacaagggcttcacactgtgggcggctgagccaggtgcagcccgagctgtgctcctgcgacagcccttcgagaagctgcagatgtcttcagatgacggtgccagtctccttttcctggattttggaggtgctgaaggcgagatccagctggacctgcactcgtgtcccaaaaccatagtcttcatcatccactccttcctgtcggccaaagtcacccgcctcgggctgttggcctagaagtcgccggatgcactagccctgaagaggggtgtccatgacatggcctgagctgggcctccaccgactgcctgctcacccctgggctgagggaagggagaggagaggaacaagggcctccgaaaccccaaccctgagggagactggattggtcttggggcccaggacccagacgcaggacagagtggactctgcctgtgatggggtggccttcctgctgcccccctccaccagtgccttttgcagagagatattttgtgtcccgaagcatcggattggacctgccctgcgatctcgcccaattgatccggtcttagccaaccccaggccttttttccgtg

SEQ ID NO: 369725 - DNA, 2684 bp, Homo sapiens
cgcccttctgacccaccccgctaggtagtcccacacggcggccctcggctcccgggccccgccccggcctcctgcatttgcccgaggccccctccccagcactggccacaccccagggtagccccgcccccagagctcctcccccagcggccggggtagggtggcggctggcccagccgggcccccgctgccctctgccctgggcgcttggtcggagcgggctgggcaaagcgggacagggcgagcgcggcggcccgggggctcggaggcgaagatggcgtccggcaggcgcgccccgcgcaccgggctgctggagctgcgcgccggggcgggctcgggggccggcggcgagcgatggcagcgggtgctgctgagtctggcggaggacgtgctgaccgtgagccccgccgacggcgaccctggtcccgagcccggcgctccgcgggagcaggagcccgcgcagctcaacggcgccgcggagccgggcgccgggcccccgcagctgccagaggcgctactgctccagcggcgccgcgtgacggtgcgcaaggccgacgccggtgggctgggcatcagcatcaaaggcggccgggagaacaagatgcctattctcatttccaagatcttcaagggattggcagctgaccagacagaggccctttttgtgggggatgccatcctgtctgtgaatggggaagacttgtcctctgctacccatgatgaggcggtgcaggtcctcaagaagacaggcaaggaggtggtgctggaggtcaagtatatgaaggacgtctcaccgtatttcaagaactctactggtgggacctcggtcggctgggactcacctcctgcctcaccccttcagcggcagccttcctcccctggccccacaccccggaacttcagcgaggccaaacacatgtccttgaagatggcatatgtctcgaagaggtgcacccccaatgacccggagcccaggtatctggagatctgctcggcagatggtcaagacaccctcttcctgagggccaaggatgaggctagtgcgaggtcgtgggcgactgccatccaagcccaggtcaatactctgacgccgcgggtcaaggatgagctgcaggcactgttggcagccaccagcacagctgggagccaggacatcaagcagattggctggctaactgagcagctgcccagtgggggcacagcccccaccctggccctgctaactgaaaaggaactgctcctctacttgtctctccccgagacccgcgaggccctgagccggccagcccgtactgccccactcatcgccaccagactggtgcactcaggcccctccaagggctcagtgccctacgatgcagagctctcttttgccctgcgcacgggcacgcgtcacggtgtggacactcacctgttcagcgtggagtcaccgcaggagctggctgcctggacccgccagcttgtggatggctgtcaccgggccgccgagggtgtgcaggaggtgtctacagcctgcacgtggaatgggcgtccctgcagcctgtctgtgcacatcgacaagggcttcacactgtgggcggctgagccaggtgcagcccgagctgtgctcctgcgacagcccttcgagaagctgcagatgtcttcagatgacggtgccagtctccttttcctggattttggaggtgctgaaggcgagatccagctggacctgcactcgtgtcccaaaaccatagtcttcatcatccactccttcctgtcggccaaagtcacccgcctcgggctgttggcctagaagtcgccggatgcactagccctgaagaggggtgtccatgacatggcctgagctgggcctccaccgactgcctgctcacccctgggctgagggaagggagaggagaggaacaagggcctccgaaaccccaaccagctgagctgccgggcctcctcgaggcccctaagccacccccagaggtcccatctgaagctggagtaccctggggtcagcagcaagagaaagaagaggagattttctgtttgtttttcccctcagccctgccaccgtggggagtctggtttttctcttcatcctgtctctctcctccttactcttggataaataaacagcctgtgagcacacaggcagcccggcccagtgtatgtggtctgtgccttggcctttgggtcctggggtggcccctgcagtcccaagatggaccagaccaaggactagggcacctttccctggagaagaacagacctttactacatgggccaaagacagtgtattggttatctattgttgtgtgacaaattatccaaaatttgcagcttaaaatgacaaatattcattatctcttaggttctgtgggtcagaaatttgagaggggctaagctgggctgttcttgtctcagggtcgctcatgaggttgcagtcaagttgtcggctagggctgcagtcatctgaaggcttgactggggctggaggatccattccaatactgctcatgcacatggctgtgggtaggaggtctcagttcctcaccatgtagggctaaccctagagctgctgcttgagttttctcatgatatggcagttggctttccccacagtgagacagaagagagggcaaggaggaagccacaaacagtgcctcttatgacccggtcttggaagccttacactg

SEQ ID NO: 369726 - DNA, 1112 bp, Homo sapiens
atagtttttaatcagcctcaaaaattccccttatttccaagtatcttatttttactatttcattgatgtttcaagtggaatcaaatattccaactgttttccactggaagaagatgaatttcaggtacaattcagtagcaaagaacacccatgttttcaaaataatggagaaatttttttctcatatgaagttatgattaaatttgtgaattgcacaagcttggaattctgctgcaggatgcctacattctgtattgctttattttggtcatatattacaaatggaatatttcccagctcatttatatacagttcctggttgctgaaattttactggcaagctttgtgaactaattttacttctcaaagatactaggaataaagtgaaaatagggtcttttctctcataggtctaaaagatacttctttcctttaaccattacattctgggaggtgtaattaatccaaccctgctgtaggatagggatctcattattaaaggattctagggtaaacagtctttctagcagaaatggatctttttggttcagtcttggcaggcatttccctaaaattgctagtgtacgtagtaaataggggagggtaagtggggggaaatttcctaaaaatgccagtgtacagagtgaattgttaggtaaatgagaaaatcaggcttgatttaccaaccaccccatgtgcacatacaaacaaacacacactcacaccaaagccaggaaccctgcaacaaagttctatttaccctgaggagatataaaactttgtgactgcccactaaattatttttttgaaaaataataccagaaatttgtaagcagacacaacagcctcctagtttatcccaccaaataacaatataaatgggacaagcaaagagaaactgtaatttgaagatttttgagtgtgatacttataaaagtgtgtgtgtttgtgtgtagaaatgtattgaatttgagagtaatttatggaaagtgctgtcagcatggtatttcaaatgcttcacaatttgaatttaaactagtcaatgggatcattaagattattatgcatgttttccaaagagtttgaattcaaatgacaacttaaaagaaaaa

SEQ ID NO: 369727 - DNA, 869 bp, Homo sapiens
gcccatggcagagctctcactccgctccaccgctacagctctctacggcgttctgtttgagaagagcaaggaagctgccttcgccaatcaccgcctgtgggaggccctgggcttcgtcattgccttcgggtacagcacgtttttgtgcgtgcacgtcaagctctacattctgctgggggtcctgagcctgaccatggtggcgtatgggcttgcggagtgcgtggagtccaagaacccgatcagaccccacgctccaggacaggcgaaccaggcagaggatgaagaaatacaaacaaaaatgtgagagcagtgaggtctgaggaggatgaactcagaaagcaccagccagagaattttcttagaagatgcctcaggacatagagcggctcctcatcaccatctcagcacaatttggccattctgaagagatcatattatttcactctttatgtattttttttctattctaacaaatttttagtccaccatcttaacagagatcaagtgtatacatgaaggtatcagttcatttaattttagatgcaaaagaaaaaggtctaacgtacaatcagccaattagaatttgcctgaaatcatagactcaccctagttttattgctgtagttgtttttaagaattggaagcctgcttaaaaaatgtagttgagccccataattttacaaatgggcgaacttttaaacttctaactctacttggatcaaaacctcatacattttacaaaggggtcctgacaagtcagctgactcaacctcacagagtcagggggtgacaaagccagactggggctcaggattcctgaaacgtgtggggtctgcgtttctaaataaagacggttatttaacggactt

SEQ ID NO: 369728 - DNA, 683 bp, Homo sapiens
gcagcgcggagtcccggcccgggacacaagatggcggcagcggcgctggggagggcgaggcggaggcggcaaaacgggcggtcgagcagaacgtgtagccgcgtcccctccagtccgctccgggcagctgctgatgcaaggaatcccctgggctcccgtccactccactgctgaccagcccattcgcctgtgctgagtcttcctgcaggcctttccttgcctctgtgggaccctgtgggggtccatccggctggagaagaaaagcctctcatgctaacgttgcagaccccagagggtgagagaaagggggacttcattcagtcttgaaacctgtgtgctcagcccccaaggcatcaggaattcttcctgcccagagaatcaaggcagcttcatttttttcgtaccttggtcagtggttctcaacctttttgttatcaaggcactttttgttgtacatatgtcctgttgccccctgcatttttatctgccaaactgtactgatggagtaaccattgacttttcccttcctaaattaaggaagacgtctatgatggagtgtacaataaaatcagtgtcccaatgattcgtatgatgtcatcaacaaccaatcagagcttctgatcagcatgagataatcagtgtgaccacaatgagttgataaaatttcagcatgaaaagataaa

SEQ ID NO: 369729 - DNA, 588 bp, Homo sapiens
gctttgaactgcaactaatggccacagatgtcaatgttggaaaggccctacaatgcatttagttgatttcccaactctgccgaaagccatctctattacttgcccccgaaggctagtttaagttgcttctactcaagagcatttacagcttgggttcgatgtatatgtagcccgggcatggggcagggcttcttaacatttggacaccacgcagcacaaaggcccagagagggaaagagactggctggaagaggcagagccgcgcgggtgccaggacccaggtccttgctacgtccggagcctacgtcaccacgatgcctcccctgggccggcggcagaacccgagacccccgcaggttctaagacagcccccacgccccccagtgcgcacgctcagtccaaccccgccgcgcaccgcccaccgcgaacatccggctcctgcgtgtgtgctcgagggggaaactgaggcggggacgtgccagtgaattcattccttcctcagtccacccgcaggcctacaaagctgtctccccttcctcagcgccacaaggaacagcagggacggatgggaagaaggggagggggccg

SEQ ID NO: 369730 - DNA, 496 bp, Homo sapiens
  misc_feature (429)..(429): n is a, c, g, or t
  misc_feature (477)..(477): n is a, c, g, or t
  misc_feature (479)..(479): n is a, c, g, or t
  misc_feature (488)..(488): n is a, c, g, or t
  misc_feature (490)..(490): n is a, c, g, or t
tctgatgcctgttgcacgcacctcgactcttaggatcccccatcggatgtgccgctccgggcagctgctgatgcaaggaatcccctgggctcccgtccactccactgctgaccagcccattcgcctgtgctgagtcttcctgcaggcctttccttgcctctgtgggaccctgtgggggtccatccggctggagaagaaaagcctctcatgctaacgttgcagaccccagagggtcctgtgtgggtgtggagatggccaatgagaatcacggcagcccccgggaggaagcgtccctgctgagtcactccccaggtacctccaatcagagccagccctgttctccaaagccaatccgcctggttcaggacctcccagaggagctggtgcatgcaggctgggagaagtgctggagcggggagcggcacatgngttgggggatcctcagagtcgaggtgcatgccacggcatcagcgggangnagtcaatananaatcca

SEQ ID NO: 369731 - DNA, 3354 bp, Homo sapiens
gcagcgcggagtcccggcccgggacacaagatggcggcagcggcgctggggagggcgaggcggaggcggcaaaacgggcggtcgagcagaacgtgtagccgcgtcccctccagtccgctccgggcagctgctgatgcaaggaatcccctgggctcccgtccactccactgctgaccagcccattcgcctgtgctgagtcttcctgcaggcctttccttgcctctgtgggaccctgtgggggtccatccggctggagaagaaaagcctctcatgctaacgttgcagaccccagagggtcctgtgtgggtgtggagatggccaatgagaatcacggcagcccccgggaggaagcgtccctgctgagtcactccccaggtacctccaatcagagccagccctgttctccaaagccaatccgcctggttcaggacctcccagaggagctggtgcatgcaggctgggagaagtgctggagccggagggagaatcgtccctactacttcaaccgattcaccaaccagtccctgtgggagatgcccgtgctggggcagcacgatgtgatttcggaccctttggggctgaatgcgaccccactgccccaagactcaagcttggtggaaactcccccggctgagaacaagcccagaaagcggcagctctcggaagagcagccaagcggcaatggtgtgaagaagcccaagattgaaatcccagtgacacccacaggccagtcggtgcccagctcccccagtatcccaggaaccccaacgctgaagatgtggggtacgtcccctgaagataaacagcaggcagctctcctacgacccactgaggtctactgggacctggacatccagaccaatgctgtcatcaagcaccgggggccttcagaggtgctgcccccgcatcccgaagtggaactgctccgctctcagctcatcctgaagcttcggcagcactatcgggagctgtgccagcagcgagagggcattgagcctccacgggagtctttcaaccgctggatgctggagcgcaaggtggtagacaaaggatctgaccccctgttgcccagcaactgtgaaccagtcgtgtcaccttccatgtttcgtgaaatcatgaacgacattcctatcaggttatcccgaatcaagttccgggaggaagccaagcgcctgctctttaaatatgcggaggccgccaggcggctcatcgagtccaggagtgcatcccctgacagtaggaaggtggtcaaatggaatgtggaagacacctttagctggcttcggaaggaccactcagcctccaaggaggactacatggatcgcctggagcatctgcggaggcagtgtggcccccacgtctcggccgcagccaaggactccgtggaaggcatctgcagtaagatctaccacatctccctggagtacgtcaaacggatccgagagaagcaccttgccatcctcaaggaaaacaacatctcagaggaggtggaggcccctgaggtggagccccgcctagtgtactgctacccagtccggctggctgtgtctgcaccgcccatgcccagcgtggagatgcacatggagaacaacgtggtctgcatccggtataagggagagatggtcaaggtcagccgcaactacttcagcaagctgtggctcctttaccgctacagctgcattgatgactctgcctttgagaggttcctgccccgggtctggtgtcttctccgacggtaccagatgatgttcggcgtgggcctctacgaggggactggcctgcagggatcgctgcctgtgcatgtctttgaggccctccaccgactctttggcgtcagcttcgagtgcttcgcctcacccctcaactgctacttccgccagtactgttctgccttccccgacacagacggctactttggctcccgcgggccctgcctagactttgctccactgagtggttcatttgaggccaaccctcccttctgcgaggagctcatggatgccatggtctctcactttgagagactgcttgagagctcaccggagcccctgtccttcatcgtgttcatccctgagtggcgggaacccccaacaccagcgctcacccgcatggagcagagccgcttcaaacgccaccagttgatcctgcctgcctttgagcatgagtaccgcagtggctcccagcacatctgcaagaaggaggaaatgcactacaaggccgtccacaacacggctgtgctcttcctacagaacgaccctggctttgccaagtgggcgccgacgcctgaacggctgcaggagctgagtgctgcctaccggcagtcaggccgcagccacagctctggttcttcctcatcgtcctcctcggaggccaaggaccgggactcgggccgtgagcagggtcctagccgcgagcctcaccccacttaacatatcctgcggggaggaggagccccaggggtgctagtctggactgctgggactcgggcccctggggcctcagagggaccccggctgccactgacatatgaagattatggttctgccagggctcccctccctgcctgtccccaagtcctcacctcaaactccctccaagtcccatgtatataggtcctgatgccttcccaaccccgcccctcaccctgttgccaccttgtttcatttgtaaaaggaaatacagaaacccccccaagaatgtgtgagggtcttgagggcagagaaggctgaggcagctggagctacttctgggaccacactcccctccctccctccagcagctccttctcatggcccctgggccttcactctcccatctggggtcccacacagctgggtccctggtggcctctgcctgggctcaggaggtccgaagagtccaaggccctgcatcccctatctccaaactcccccagcagggcctgtatggatacccctggggatcagaggactgggagctgtgcctgtccccaacccaaaagccagactcttgctggccctggatccccacagtgagcgaagagctgggtgtgcctcacagtcaaggctcaggagagcagcttcagaggatctgtaggcacagagcgtgtgctccctagggcccagggaggaagcaggtctgaaggtgcttgctggggctctcgctggttcagccgtctctgaaccagccacctctctcattgccaggcctctgcagcaagggtctgccctgctggtggatcaccggacttaacaggggcagggcaggacagggcacgctgtggagccaggcagcctccacctcacaagacctggcctggtacaggctacagcagcaagcagacaaagtaagctgttcaggactggactccggtcc

SEQ ID NO: 369732 - DNA, 2675 bp, Homo sapiens
gcagcgcggagtcccggcccgggacacaagatggcggcagcggcgctggggagggcgaggcggaggcggcaaaacgggcggtcgagcagaacgtgtagccgcgtcccctccagtccgctccgggcagctgctgatgcaaggaatcccctgggctcccgtccactccactgctgaccagcccattcgcctgtgctgagtcttcctgcaggcctttccttgcctctgtgggaccctgtgggggtccatccggctggagaagaaaagcctctcatgctaacgttgcagaccccagagggtcctgtgtgggtgtggagatggccaatgagaatcacggcagcccccgggaggaagcgtccctgctgagtcactccccaggtacctccaatcagagccagccctgttctccaaagccaatccgcctggttcaggacctcccagaggagctggtgcatgcaggctgggagaagtgctggagccggagggagaatcgtccctactacttcaaccgattcaccaaccagtccctgtgggagatgcccgtgctggggcagcacgatgtgatttcggaccctttggggctgaatgcgaccccactgccccaagactcaagcttggtggaaactcccccggctgagaacaagcccagaaagcggcagctctcggaagagcagccaagcggcaatggtgtgaagaagcccaagattgaaatcccagtgacacccacaggccagtcggtgcccagctcccccagtatcccaggaaccccaacgctgaagatgtggggtacgtcccctgaagataaacagcaggcagctctcctacgacccactgaggtctactgggacctggacatccagaccaatgctgtcatcaagcaccgggggccttcagaggtgctgcccccgcatcccgaagtggaactgctccgctctcagctcatcctgaagcttcggcagcactatcgggagctgtgccagcagcgagagggcattgagcctccacgggagtctttcaaccgctggatgctggagcgcaaggtggtagacaaaggatctgaccccctgttgcccagcaactgtgaaccagtcgtgtcaccttccatgtttcgtgaaatcatgaacgacattcctatcaggttatcccgaatcaagttccgggaggaagccaagcgcctgctctttaaatatgcggaggccgccaggcggctcatcgagtccaggagtgcatcccctgacagtaggaaggtggtcaaatggaatgtggaagacacctttagctggcttcggaaggaccactcagcctccaaggaggactacatggatcgcctggagcatctgcggaggcagtgtggcccccacgtctcggccgcagccaaggactccgtggaaggcatctgcagtaagatctaccacatctccctggagtacgtcaaacggatccgagagaagcaccttgccatcctcaaggaaaacaacatctcagaggaggtggaggcccctgaggtggagccccgcctagtgtactgctacccagtccggctggctgtgtctgcaccgcccatgcccagcgtggagatgcacatggagaacaacgtggtctgcatccggtataagggagagatggtcaaggtcagccgcaactacttcagcaagctgtggctcctttaccgctacagctgcattgatgactctgcctttgagaggttcctgccccgggtctggtgtcttctccgacggtaccagatgatgttcggcgtgggcctctacgaggggactggcctgcagggatcgctgcctgtgcatgtctttgaggccctccaccgactctttggcgtcagcttcgagtgcttcgcctcacccctcaactgctacttccgccagtactgttctgccttccccgacacagacggctactttggctcccgcgggccctgcctagactttgctccactgagtggttcatttgaggccaaccctcccttctgcgaggagctcatggatgccatggtctctcactttgagagactgcttgagagctcaccggagcccctgtccttcatcgtgttcatccctgagtggcgggaacccccaacaccagcgctcacccgcatggagcagagccgcttcaaacgccaccagttgatcctgcctgcctttgagcatgagtaccgcagtggctcccagcacatctgcaagaaggaggaaatgcactacaaggccgtccacaacacggctgtgctcttcctacagaacgaccctggctttgccaagtgggcgccgacgcctgaacggctgcaggagctgagtgctgcctaccggcagtcaggccgcagccacagctctggttcttcctcatcgtcctcctcggaggccaaggaccgggactcgggccgtgagcagggtcctagccgcgagcctcaccccacttaacatatcctgcggggaggaggagccccaggggtgctagtctggactgctgggactcgggcccctggggcctcagagggaccccggctgccactgacatatgaagattatggttctgccagggctcccctccctgcctgtccccaagtcctcacctcaaactccctccaagtcccatgtatataggtcctgatgccttcccaaccccgcccttttctttttttttcttttttcttttttttttttttt

SEQ ID NO: 369733 - DNA, 2808 bp, Homo sapiens
gcagcgcggagtcccggcccgggacacaagatggcggcagcggcgctggggagggcgaggcggaggcggcaaaacgggcggtcgagcagaacgtgtagccgcgtcccctccagtccgctccgggcagctgctgatgcaaggaatcccctgggctcccgtccactccactgctgaccagcccattcgcctgtgctgagtcttcctgcaggcctttccttgcctctgtgggaccctgtgggggtccatccggctggagaagaaaagcctctcatgctaacgttgcagaccccagagggtgagagaaagggggacttcattcagtcttgaaacctgtgtgctcagcccccaaggcatcaggaattcttcctgcccagagaatcaaggcagcttcatttttttcgtaccttggtcctgtgtgggtgtggagatggccaatgagaatcacggcagcccccgggaggaagcgtccctgctgagtcactccccaggtacctccaatcagagccagccctgttctccaaagccaatccgcctggttcaggacctcccagaggagctggtgcatgcaggctgggagaagtgctggagccggagggagaatcgtccctactacttcaaccgattcaccaaccagtccctgtgggagatgcccgtgctggggcagcacgatgtgatttcggaccctttggggctgaatgcgaccccactgccccaagactcaagcttggtggaaactcccccggctgagaacaagcccagaaagcggcagctctcggaagagcagccaagcggcaatggtgtgaagaagcccaagattgaaatcccagtgacacccacaggccagtcggtgcccagctcccccagtatcccaggaaccccaacgctgaagatgtggggtacgtcccctgaagataaacagcaggcagctctcctacgacccactgaggtctactgggacctggacatccagaccaatgctgtcatcaagcaccgggggccttcagaggtgctgcccccgcatcccgaagtggaactgctccgctctcagctcatcctgaagcttcggcagcactatcgggagctgtgccagcagcgagagggcattgagcctccacgggagtctttcaaccgctggatgctggagcgcaaggtggtagacaaaggatctgaccccctgttgcccagcaactgtgaaccagtcgtgtcaccttccatgtttcgtgaaatcatgaacgacattcctatcaggttatcccgaatcaagttccgggaggaagccaagcgcctgctctttaaatatgcggaggccgccaggcggctcatcgagtccaggagtgcatcccctgacagtaggaaggtggtcaaatggaatgtggaagacacctttagctggcttcggaaggaccactcagcctccaaggaggactacatggatcgcctggagcatctgcggaggcagtgtggcccccacgtctcggccgcagccaaggactccgtggaaggcatctgcagtaagatctaccacatctccctggagtacgtcaaacggatccgagagaagcaccttgccatcctcaaggaaaacaacatctcagaggaggtggaggcccctgaggtggagccccgcctagtgtactgctacccagtccggctggctgtgtctgcaccgcccatgcccagcgtggagatgcacatggagaacaacgtggtctgcatccggtataagggagagatggtcaaggtcagccgcaactacttcagcaagctgtggctcctttaccgctacagctgcattgatgactctgcctttgagaggttcctgccccgggtctggtgtcttctccgacggtaccagatgatgttcggcgtgggcctctacgaggggactggcctgcagggatcgctgcctgtgcatgtctttgaggccctccaccgactctttggcgtcagcttcgagtgcttcgcctcacccctcaactgctacttccgccagtactgttctgccttccccgacacagacggctactttggctcccgcgggccctgcctagactttgctccactgagtggttcatttgaggccaaccctcccttctgcgaggagctcatggatgccatggtctctcactttgagagactgcttgagagctcaccggagcccctgtccttcatcgtgttcatccctgagtggcgggaacccccaacaccagcgctcacccgcatggagcagagccgcttcaaacgccaccagttgatcctgcctgcctttgagcatgagtaccgcagtggctcccagcacatctgcaagaaggaggaaatgcactacaaggccgtccacaacacggctgtgctcttcctacagaacgaccctggctttgccaagtgggcgccgacgcctgaacggctgcaggagctgagtgctgcctaccggcagtcaggccgcagccacagctctggttcttcctcatcgtcctcctcggaggccaaggaccgggactcgggccgtgagcagggtcctagccgcgagcctcaccccacttaacatatcctgcggggaggaggagccccaggggtgctagtctggactgctgggactcgggcccctggggcctcagagggaccccggctgccactgacatatgaagattatggttctgccagggctcccctccctgcctgtccccaagtcctcacctcaaactccctccaagtcccatgtatataggtcctgatgccttcccaaccccgcccctcaccctgttgccaccttgtttcatttgtaaaaggaaatacagaaacccccccaag

SEQ ID NO: 369734 - DNA, 457 bp, Homo sapiens
gccagtgaattcattccttcctcagtccacccgcaggcctacaaagctgtctccccttcctcagcgccacaaggaacagcagggacggatgggaagaaggggagggggccgaaagcaagctgggtgcgaggagccagccgaccctgccacactcaagatggcggcgcggccgcggcgaggtccctcagaggcggtaccagcgcatgcgcagcgcggagtcccggcccgggacacaagatggcggcagcggcgctggggagggcgaggcggaggcggcaaaacgggcggtcgagcagaacgtgtagccgcgtcccctccagtccgctccgggcaggtaagagtcccaggaagccatggtcccgcagcgagccgcgccagggtctggggatccgaagctggggggcggcggcccctccggcgctttctgctcgggactgccgcttgccctgtctctgtt

SEQ ID NO: 369735 - DNA, 2695 bp, Homo sapiens
gcagcgcggagtcccggcccgggacacaagatggcggcagcggcgctggggagggcgaggcggaggcggcaaaacgggcggtcgagcagaacgtgtagccgcgtcccctccagtccgctccgggcagctgctgatgcaaggaatcccctgggctcccgtccactccactgctgaccagcccattcgcctgtgctgagtcttcctgcaggcctttccttgcctctgtgggaccctgtgggggtccatccggctggagaagaaaagcctctcatgctaacgttgcagaccccagagggtcctgtgtgggtgtggagatggccaatgagaatcacggcagcccccgggaggaagcgtccctgctgagtcactccccaggtacctccaatcagagccagccctgttctccaaagccaatccgcctggttcaggacctcccagaggagctggtgcatgcaggctgggagaagtgctggagccggagggagaatcgtccctactacttcaaccgattcaccaaccagtccctgtgggagatgcccgtgctggggcagcacgatgtgatttcggaccctttggggctgaatgcgaccccactgccccaagactcaagcttggtggaaactcccccggctgagaacaagcccagaaagcggcagctctcggaagagcagccaagcggcaatggtgtgaagaagcccaagattgaaatcccagtgacacccacaggccagtcggtgcccagctcccccagtatcccaggaaccccaacgctgaagatgtggggtacgtcccctgaagataaacagcaggcagctctcctacgacccactgaggtctactgggacctggacatccagaccaatgctgtcatcaagcaccgggggccttcagaggtgctgcccccgcatcccgaagtggaactgctccgctctcagctcatcctgaagcttcggcagcactatcgggagctgtgccagcagcgagagggcattgagcctccacgggagtctttcaaccgctggatgctggagcgcaaggtggtagacaaaggatctgaccccctgttgcccagcaactgtgaaccagtcgtgtcaccttccatgtttcgtgaaatcatgaacgacattcctatcaggttatcccgaatcaagttccgggaggaagccaagcgcctgctctttaaatatgcggaggccgccaggcggctcatcgagtccaggagtgcatcccctgacagtaggaaggtggtcaaatggaatgtggaagacacctttagctggcttcggaaggaccactcagcctccaaggaggactacatggatcgcctggagcatctgcggaggcagtgtggcccccacgtctcggccgcagccaaggactccgtggaaggcatctgcagtaagatctaccacatctccctggagtacgtcaaacggatccgagagaagcaccttgccatcctcaaggaaaacaacatctcagaggaggtggaggcccctgaggtggagccccgcctagtgtactgctacccagtccggctggctgtgtctgcaccgcccatgcccagcgtggagatgcacatggagaacaacgtggtctgcatccggtataagggagagatggtcaaggtcagccgcaactacttcagcaagctgtggctcctttaccgctacagctgcattgatgactctgcctttgagaggttcctgccccgggtctggtgtcttctccgacggtaccagatgatgttcggcgtgggcctctacgaggggactggcctgcagggatcgctgcctgtgcatgtctttgaggccctccaccgactctttggcgtcagcttcgagtgcttcgcctcacccctcaactgctacttccgccagtactgttctgccttccccgacacagacggctactttggctcccgcgggccctgcctagactttgctccactgagtggttcatttgaggccaaccctcccttctgcgaggagctcatggatgccatggtctctcactttgagagactgcttgagagctcaccggagcccctgtccttcatcgtgttcatccctgagtggcgggaacccccaacaccagcgctcacccgcatggagcagagccgcttcaaacgccaccagttgatcctgcctgcctttgagcatgagtaccgcagtggctcccagcacatctgcaagaaggaggaaatgcactacaaggccgtccacaacacggctgtgctcttcctacagaacgaccctggctttgccaagtgggcgccgacgcctgaacggctgcaggagctgagtgctgcctaccggcagtcaggccgcagccacagctctggttcttcctcatcgtcctcctcggaggccaaggaccgggactcgggccgtgagcagggtcctagccgcgagcctcaccccacttaacatatcctgcggggaggaggagccccaggggtgctagtctggactgctgggactcgggcccctggggcctcagagggaccccggctgccactgacatatgaagattatggttctgccagggctcccctccctgcctgtccccaagtcctcacctcaaactccctccaagtcccatgtatataggtcctgatgccttcccaaccccgcccctcaccctgttgccaccttgtttcatttgtaaaaggaaatacagaaacccccccaag

SEQ ID NO: 369736 - DNA, 2780 bp, Homo sapiens
gcagcgcggagtcccggcccgggacacaagatggcggcagcggcgctggggagggcgaggcggaggcggcaaaacgggcggtcgagcagaacgtgtagccgcgtcccctccagtccgctccgggcagctgctgatgcaaggaatcccctgggctcccgtccactccactgctgaccagcccattcgcctgtgctgagtcttcctgcaggcctttccttgcctctgtgggaccctgtgggggtccatccggctggagaagaaaagcctctcatgctaacgttgcagaccccagagggtcctgtgtgggtgtggagatggccaatgagaatcacggcagcccccgggaggaagcgtccctgctgagtcactccccaggtacctccaatcagagccagccctgttctccaaagccaatccgcctggttcaggacctcccagaggagctggtgcatgcaggctgggagaagtgctggagccggagggagaatcgtccctactacttcaaccgattcaccaaccagtccctgtgggagatgcccgtgctggggcagcacgatgtgatttcggaccctttggggctgaatgcgaccccactgccccaagactcaagcttggtggaaactcccccggctgagaacaagcccagaaagcggcagctctcggaagagcagccaagcggcaatggtgtgaagaagcccaagattgaaatcccagtgacacccacaggccagtcggtgcccagctcccccagtatcccaggaaccccaacgctgaagatgtggggtacgtcccctgaagataaacagcaggcagctctcctacgacccactgaggtctactgggacctggacatccagaccaatgctgtcatcaagcaccgggggccttcagaggtgctgcccccgcatcccgaagtggaactgctccgctctcagctcatcctgaagcttcggcagcactatcgggagctgtgccagcagcgagagggcattgagcctccacgggagtctttcaaccgctggatgctggagcgcaaggtggtagacaaaggatctgaccccctgttgcccagcaactgtgaaccagtcgtgtcaccttccatgtttcgtgaaatcatgaacgacattcctatcaggttatcccgaatcaagttccgggaggaagccaagcgcctgctctttaaatatgcggaggccgccaggcggctcatcgagtccaggagtgcatcccctgacagtaggaaggtggtcaaatggaatgtggaagacacctttagctggcttcggaaggaccactcagcctccaaggaggactacatggatcgcctggagcatctgcggaggcagtgtggcccccacgtctcggccgcagccaaggactccgtggaaggcatctgcagtaagatctaccacatctccctggagtacgtcaaacggatccgagagaagcaccttgccatcctcaaggaaaacaacatctcagaggaggtggaggcccctgaggtggagccccgcctagtgtactgctacccagtccggctggctgtgtctgcaccgcccatgcccagcgtggagatgcacatggagaacaacgtggtctgcatccggtataagggagagatggtcaaggtcagccgcaactacttcagcaagctgtggctcctttaccgctacagctgcattgatgactctgcctttgagaggttcctgccccgggtctggtgtcttctccgacggtaccagatgatgttcggcgtgggcctctacgaggggactggcctgcagggatcgctgcctgtgcatgtctttgaggccctccaccgactctttggcgtcagcttcgagtgcttcgcctcacccctcaactgctacttccgccagtactgttctgccttccccgacacagacggctactttggctcccgcgggccctgcctagactttgctccactgagtggttcatttgaggccaaccctcccttctgcgaggagctcatggatgccatggtctctcactttgagagactgcttgagagctcaccggagcccctgtccttcatcgtgttcatccctgagtggcgggaacccccaacaccagcgctcacccgcatggagcagagccgcttcaaacgccaccagttgatcctgcctgcctttgagcatgagtaccgcagtggctcccagcacatctgcaagaagtgggtgccagggagggcaggggaaggaggctgggctggccaggccaggcccagccccaccctgagccattgcctttgcccgcagggaggaaatgcactacaaggccgtccacaacacggctgtgctcttcctacagaacgaccctggctttgccaagtgggcgccgacgcctgaacggctgcaggagctgagtgctgcctaccggcagtcaggccgcagccacagctctggttcttcctcatcgtcctcctcggaggccaaggaccgggactcgggccgtgagcagggtcctagccgcgagcctcaccccacttaacatatcctgcggggaggaggagccccaggggtgctagtctggactgctgggactcgggcccctggggcctcagagggaccccggctgccactgacatatgaagattatggttctgccagggctcccctccctgcctgtccccaagtcctcacctcaaactccctccaagtcccatgtatataggtcctgatgccttcccaaccccgcccctcaccctgttgccaccttgtttcatttgtaaaaggaaatacagaaacccccccaag

SEQ ID NO: 369737 - DNA, 2709 bp, Homo sapiens
gcagcgcggagtcccggcccgggacacaagatggcggcagcggcgctggggagggcgaggcggaggcggcaaaacgggcggtcgagcagaacgtgtagccgcgtcccctccagtccgctccgggcagctgctgatgcaaggaatcccctgggctcccgtccactccactgctgaccagcccattcgcctgtgctgagtcttcctgcaggcctttccttgcctctgtgggaccctgtgggggtccatccggctggagaagaaaagcctctcatgctaacgttgcagaccccagagggtcctgtgtgggtgtggagatggccaatgagaatcacggcagcccccgggaggaagcgtccctgctgagtcactccccaggtacctccaatcagagccagccctgttctccaaagccaatccgcctggttcaggacctcccagaggagctggtgcatgcaggctgggagaagtgctggagccggagggagaatcgtccctactacttcaaccgattcaccaaccagtccctgtgggagatgcccgtgctggggcagcacgatgtgatttcggaccctttggggctgaatgcgaccccactgccccaagactcaagcttggtggaaactcccccggctgagaacaagcccagaaagcggcagctctcggaagagcagccaagcggcaatggtgtgaagaagcccaagattgaaatcccagtgacacccacaggccagtcggtgcccagctcccccagtatcccaggaaccccaacgctgaagatgtggggtacgtcccctgaagataaacagcaggcagctctcctacgacccactgaggtctactgggacctggacatccagaccaatgctgtcatcaagcaccgggggccttcagaggtgctgcccccgcatcccgaagtggaactgctccgctctcagctcatcctgaagcttcggcagcactatcgggagctgtgccagcagcgagagggcattgagcctccacgggagtctttcaaccgctggatgctggagcgcaaggtggtagacaaaggatctgaccccctgttgcccagcaactgtgaaccagtcgtgtcaccttccatgtttcgtgaaatcatgaacgacattcctatcaggttatcccgaatcaagttccgggaggaagccaagcgcctgctctttaaatatgcggaggccgccaggcggctcatcgagtccaggagtgcatcccctgacagtaggaaggtggtcaaatggaatgtggaagacacctttagctggcttcggaaggaccactcagcctccaaggaggactacatggatcgcctggagcatctgcggaggcagtgtggcccccacgtctcggccgcagccaaggactccgtggaaggcatctgcagtaagatctaccacatctccctggagtacgtcaaacggatccgagagaagcaccttgccatcctcaaggaaaacaacatctcagaggaggtggaggcccctgaggtggagccccgcctagtgtactgctacccagtccggctggctgtgtctgcaccgcccatgcccagcgtggagatgcacatggagaacaacgtggtctgcatccggtataagggagagatggtcaaggtcagccgcaactacttcagcaagctgtggctcctttaccgctacagctgcattgatgactctgcctttgagaggttcctgccccgggtctggtgtcttctccgacggtaccagatgatgttcggcgtgggcctctacgaggggactggcctgcagggatcgctgcctgtgcatgtctttgaggccctccaccgactctttggcgtcagcttcgagtgcttcgcctcacccctcaactgctacttccgccagtactgttctgccttccccgacacagacggctactttggctcccgcgggccctgcctagactttgctccactgagtggttcatttgaggccaaccctcccttctgcgaggagctcatggatgccatggtctctcactttgagagactgcttgagagctcaccggagcccctgtccttcatcgtgttcatccctgagtggcgggaacccccaacaccagcgctcacccgcatggagcagagccgcttcaaacgccaccagttgatcctgcctgcctttgagcatgagtaccgcagtggctcccagcacatctgcaagaaggaggaaatgcactacaaggccgtccacaacacggctgtgctcttcctacagaacgaccctggctttgccaagtgggcgccgacgcctgaacggctgcaggagctgagtgctgcctaccggcagtcaggccgcagccacagctctggttcttcctcatcgtcctcctcggaggccaaggaccgggactcgggccgtgagcagggtcctagccgcgagcctcaccccacttaacatatcctgcggggaggaggagccccaggggtgctagtctggactgctgggactcgggcccctggggcctcagagggaccccggctgccactgacatatgaagattatggttctgccagggctcccctccctgcctgtccccaagtcctcacctcaaactccctccaagtcccatgtatataggtcctgatgccttcccaaccccgcccctcacctgtgcaatcagctcgattgtaaaagtaaacgactctcgtgtgttttcgtgttttctgttttgtgt

SEQ ID NO: 369738 - DNA, 1079 bp, Homo sapiens
gcactgctgaaggctcctcctctctgtcccgctccacagtggctcctttaccgctacagctgcattgatgactctgcctttgagaggttcctgccccgggtctggtgtcttctccgacggtaccagatgatgttcggcgtgggcctctacgaggggactggcctgcagggatcgctgcctgtgcatgtctttgaggccctccaccgactctttggcgtcagcttcgagtgcttcgcctcacccctcaactgctacttccgccagtactgttctgccttccccgacacagacggctactttggctcccgcgggccctgcctagactttgctccactgagtggttcatttgaggccaaccctcccttctgcgaggagctcatggatgccatggtctctcactttgagagactgcttgagagctcaccggagcccctgtccttcatcgtgttcatccctgagtggcgggaacccccaacaccagcgctcacccgcatggagcagagccgcttcaaacgccaccagttgatcctgcctgcctttgagcatgagtaccgcagtggctcccagcacatctgcaagaaggaggaaatgcactacaaggccgtccacaacacggctgtgctcttcctacagaacgaccctggctttgccaagtgggcgccgacgcctgaacggctgcaggagctgagtgctgcctaccggcagtcaggccgcagccacagctctggttcttcctcatcgtcctcctcggaggccaaggaccgggactcgggccgtgagcagggtcctagccgcgagcctcaccccacttaacatatcctgcggggaggaggagccccaggggtgctagtctggactgctgggactcgggcccctggggcctcagagggaccccggctgccactgacatatgaagattatggttctgccagggctcccctccctgcctgtccccaagtcctcacctcaaactccctccaagtcccatgtatataggtcctgatgccttcccaaccccgcccctcaccctgttgccaccttgtttcatttgtaaaaggaaatacagaaacccccccaag

SEQ ID NO: 369739 - DNA, 417 bp, Homo sapiens
ctcagctactcaggaggctgaggcagaagaatcacttgaaccaggaggcagaggttgcagtgagctgagatcgtgccactgcactccagcttaggcgacagagcgagactctgcctcaaaaaaaattaattaattaaaaaataaaaataattataaaataaaatcaatcatctaagtttgcacattagtaaaatagagaaagaataaataacaatcagtttataagttaaacttccacattggggaaaatagcgaaagaagagcaatgtaaatctaagttagcagaagaaaatagataacaaaaattagagcagaaatcagtgaaattgaaagtagaaacagtaggcaaaaatcaataaaagcaagaccggttctttgaaaagatcaataaaattgataaacctttaggctaaccac

SEQ ID NO: 369740 - DNA, 269 bp, Homo sapiens
gccctaatgatcgcttttcttgaaagtaagagttagcagcgtctcaggtgttatatgtgttacctgaatccaactctgtgcctgcatatactcatcagtccagtttacaattgcaggcctggcctggtccccagtgcagacacttatgagctgtggatattgggaagtttcctttctctgcctcaattttctttctgtaaaaaggagatgatgattaaaaatatccgccagttagggctgaggtaggaactaaatgaattatatcaatc

SEQ ID NO: 369741 - DNA, 224 bp, Homo sapiens
  misc_feature (9)..(10): n is a, c, g, or t
cctcgcgannatattttcaagtattctttatgtacaaagagctactctacctggaaagaatacttgaaaaattaattgtatgatgtatgagaagacagagtctcctagttttgtatcttgttgtatgactgccatgagttccaccagaaagccactctattttggtctctgtgacattttaaatgcgtgacagaagtgagcaaataaagtgaggaagaaatcta

SEQ ID NO: 369742 - DNA, 1084 bp, Homo sapiens
aacgcgctgatagcctcctccctgttgccacacacagctgtggctctttcacctccattgctgtttagaatcccagcatctgcggacccattctgctgatttgactggtttctcctggacactctcttcgcagccttggtcatctataatttcctgagcctgtgctatgagtacctaggaggagaaagttccatcatgtcggagatcagaggaaaacccattgagtccagctgtatgtatggcacctgctgcctctggggaaagacttattccatcggatttctgaggttctgcaaacaggccaccctgcagttctgtgtggtgaagccactcatggcggtcagcactgtggtcctccaggccttcggcaagtaccgggatggggactttgagtaagcagcgggtgctccccggggtgtgtgggaggagtgttggcgcaggctggtgccttggctcagggaagggggcagccagagtggccgcacagccatgaccttcctgggtgtctggtgctcacaacccccctgaagtctgagcccagcagtggacacccttgcagttggccccgctgccagcccctgagtgagccattggcagcagtcacgttcatgtccaggctgcagagtggtaccatgaagggatgggccacaaagggacagtgaccactgctgaggcagggagcgagagggtcagagccccaagaggtcggctcaagtccacagatacaaagcccgtgctgtgtaaattgtccacacccatttcattctgggcttagtgaaagtgaccccgtggctgggcacagtggttcacgcctgtaatcctagcactttgggaggccaacgcgggtagatcacctgaggtcaggagttcaagaccagcctggccaacatggtgaaaccccatcactactaaaaatacaaaaaattaaccgggcgtggtgacgggtgcctataatcccagctactcgggaggctgaggcaggagaatcgcttgaacccaggaggcagaggttgcggtgagccaagatcacgccattgcactctagcctgggtgacaagaacaaaactccatatctaaaaaaaaa

SEQ ID NO: 369743 - DNA, 869 bp, Homo sapiens
gttgggggccggtcgtagctggttttgtgagtggcaagagaacccgggtcgcgccccaacccgcggggcggcgggctggggttcggggcggcgggctggggttcggggcgcggcccctttaaggcccaggcagtgatctcagccgcgtccgccgccccgccctccccggcggcgagcccagagcgcatgcgcgccgcggctgcactccactgggcccgggacgcgccggcggcggcggagactccggggctgcggcgccgcccgccccgcccgcagagtccggctgccgcgcatcgtccgcagacgccgccaccgccatgggctcctgaggtatcccgcctggccggcctcgcccgggagccccaagggggagctgcgactcccgagcgcggggggctgcttgtttcggagaggcccgcgcgagggacgcccggcttcggccgccggctcccgggcggggagggcactacggaggccggtgcggccgcggagggagggggcatccgtctccccacccgtgcctcctctccgccccgcgaggtcgcccgtgggtgtgcccgctccctttccacgccaacgtggcgggggcagctcctggagtgtaatcggacctgtccggggggcggccccgggagagggaggcggatggaccaaggcgctttgcaagagggattgtgtgctcccgggtgggtgtgctggcgactggcacggccgagtgagtgggggaggcgtccgtgccctgtgcgggtggcagtgacctgggagggtggtcggcggggggctttcggggctgcgtcgtgagtggagggtgtacacgcccgccacacaggtccgcaggtttggaaggggatcgactgggacctggggct

SEQ ID NO: 369744 - DNA, 3591 bp, Homo sapiens
gttgggggccggtcgtagctggttttgtgagtggcaagagaacccgggtcgcgccccaacccgcggggcggcgggctggggttcggggcggcgggctggggttcggggcgcggcccctttaaggcccaggcagtgatctcagccgcgtccgccgccccgccctccccggcggcgagcccagagcgcatgcgcgccgcggctgcactccactgggcccgggacgcgccggcggcggcggagactccggggctgcggcgccgcccgccccgcccgcagagtccggctgccgcgcatcgtccgcagacgccgccaccgccatgggctcctgaggctagcttgtcactttctgcaaaggtttccctcagggagcctcctgctgccaggcaccatgacagtgaggggggatgtgctggccccggatccagcgtcgcccacgaccgcagcagcctcgcccagcgtctccgtgatccccgagggcagccccactgccatggagcagcctgtgttcctgatgacaactgccgctcaggccatctctggcttcttcgtgtggacggccctgctcatcacatgccaccagccttggtcatctataatttcctgagcctgtgctatgagtacctaggaggagaaagttccatcatgtcggagatcagaggaaaacccattgagtccagctgtatgtatggcacctgctgcctctggggaaagacttattccatcggatttctgaggttctgcaaacaggccaccctgcagttctgtgtggtgaagccactcatggcggtcagcactgtggtcctccaggccttcggcaagtaccgggatggggactttgacgtcaccagtggctacctctacgtgaccatcatctacaacatctccgtcagcctggccctctacgccctcttcctcttctacttcgccacccgggagctgctcagcccctacagccccgtcctcaagttcttcatggtcaagtccgtcatctttctttccttctggcaaggcatgctcctggccatcctggagaagtgtggggccatccccaaaatccactcggcccgcgtgtcggtgggcgagggcaccgtggctgccggctaccaggacttcatcatctgtgtggagatgttctttgcagccctggccctgcggcacgccttcacctacaaggtctatgctgacaagaggctggacgcacaaggccgctgtgcccccatgaagagcatctccagcagcctcaaggagaccatgaacccgcacgacatcgtgcaggacgccatccacaacttctcacctgcctaccagcagtacacgcagcagtccaccctggagcctgggcccacctggcgtggtggcgcccacggcctctcccgctcccacagcctcagtggcgcccgcgacaacgagaagactctcctgctcagctctgatgatgaattctaggtgcgggctgcagtggcggaagtgctggcgccatagccacggtcaggctgtgccccacctccagcctcaccaccaggccaggaggcagctggcacagtgctcacgccgcctttatttattggaccagaaacactcacatgtcacttccagaggaacgggggacagccaggctcgcccatgggccttcaggaatatttatacatggcccagcctgcactgcccgggcgagggcagaggacactgggagcaaggcttatgcccctgctgcccgtcctgtgctgggggcatgctgggaccagccgcacccaggccccaatgcttgtgtgtggaccagcggctgcagccttctagcccctcctccccgcgagactctcaggctgaggtcggcaagccgtggctcccccacacaccgtgcaataccctgtctgacctgggctcttcccgcctgcatccctcccctgtccacctttgtccagtgctagattcacctcaccccgggcaggagtggggatgtgggcgctctgtggtcctcccctcctgacccaggcctctgtggcatgctgcaaggatcagagccagacaccaggagtcacaggccccacccaggaagggcattcagggcccctgggcaccgcttctgttgaagcaggggcttctgggcccctgggtatccccacctgtcgtggccacacctctgcctgcctcatgccccttccccctggcctaccaaggacagcccacagcccgcactgccggctcacttgggtccttcctcgatagctttgggcagagcccttgcttcctggctgcttcagggctcaggggctcccagccctccttcccaggctgatgctgggtcctctctctctttggggcttctccctcccgtttcaggggaaaggtctgagtctccacgtttcagaccagcttctgggggaaggcagtccggcagggagaccgggaggggtggccacacagtggggagctgggaggtggggggaatggtcccagactcctctcggggcccctatccacacagggcctggtgttctaccccatctggcccctggcccatctcttctgtgccttagtcacatatgaaagcgcccctccctggctccccatctgtcccacacgctccctggggctcttagttcagctgctggcactcgcaggatcctgcagtgctgggcccagagcccttggacaggcctcaggagtggtcaggaccaccaagcccctcctctccccctccacacctctagacctggggcctccggaacccccagcaggctgggcttatactagctcctgacttaggaagagcctcgtgtcacaacacgtgtccctacaggcaaagtgtcctggcatttaaaacccagattatccctgggtttgggctgcagtcacctggagaagctggtagggtaagggagagggaccctgccggtgttcactggggattctttcttttggtccttcctggaatgaacaggttccctccctgccacctgtgaggagagttggggcccagccgtcttcctggcctccttcctttcctcgtggcagaggcctgcatgtgggtgccagaggccagctctccccctccatcttgggggggcggagcagttgggcccaagctgcccgggagggtgggtgcagacacaggctgaggaccagccctggccctgccccgccatctgctttcaccaagctgtctctccaccgtggcttcccttctccctccaggccaaagtgctgctgattcccactcccttggttttcgcctgcccagcgttgctgtttgcgtggagggtggggggagctcagtggcagggaatcagcggtccgtggggtcgtggggacgggaacatgtgcccgaccgctccatcccctcctcctccttaggatgcataacctaccttgtctttttttttttaaattttctttccaggtagagtagctctttgtacataaagaatacttgaaaaattaattgtatgatgtatgagaagacagagtctcctagttttgtatcttgttgtatgactgccatgagttccaccagaaagccactctattttggtctctgtgacattttaaatgcgtgacagaagtgagcaaataaagtgaggaagaaatcta

SEQ ID NO: 369745 - DNA, 2801 bp, Homo sapiens
gcccctgcctggcagatgcacttttcaactttcacctcaacttggaccctgctctcttctactcaaagtctagctgggtggcctctgtaatttgccctttgtgtttcttactaatatccttccgaactttggacgcgcatcctgcgcttcgaagcgcacgatgccccgtcctcaagttcttcatggtcaagtccgtcatctttctttccttctggcaaggcatgctcctggccatcctggagaagtgtggggccatccccaaaatccactcggcccgcgtgtcggtgggcgagggcaccgtggctgccggctaccaggacttcatcatctgtgtggagatgttctttgcagccctggccctgcggcacgccttcacctacaaggtctatgctgacaagaggctggacgcacaaggccgctgtgcccccatgaagagcatctccagcagcctcaaggagaccatgaacccgcacgacatcgtgcaggacgccatccacaacttctcacctgcctaccagcagtacacgcagcagtccaccctggagcctgggcccacctggcgtggtggcgcccacggcctctcccgctcccacagcctcagtggcgcccgcgacaacgagaagactctcctgctcagctctgatgatgaattctaggtgcgggctgcagtggcggaagtgctggcgccatagccacggtcaggctgtgccccacctccagcctcaccaccaggccaggaggcagctggcacagtgctcacgccgcctttatttattggaccagaaacactcacatgtcacttccagaggaacgggggacagccaggctcgcccatgggccttcaggaatatttatacatggcccagcctgcactgcccgggcgagggcagaggacactgggagcaaggcttatgcccctgctgcccgtcctgtgctgggggcatgctgggaccagccgcacccaggccccaatgcttgtgtgtggaccagcggctgcagccttctagcccctcctccccgcgagactctcaggctgaggtcggcaagccgtggctcccccacacaccgtgcaataccctgtctgacctgggctcttcccgcctgcatccctcccctgtccacctttgtccagtgctagattcacctcaccccgggcaggagtggggatgtgggcgctctgtggtcctcccctcctgacccaggcctctgtggcatgctgcaaggatcagagccagacaccaggagtcacaggccccacccaggaagggcattcagggcccctgggcaccgcttctgttgaagcaggggcttctgggcccctgggtatccccacctgtcgtggccacacctctgcctgcctcatgccccttccccctggcctaccaaggacagcccacagcccgcactgccggctcacttgggtccttcctcgatagctttgggcagagcccttgcttcctggctgcttcagggctcaggggctcccagccctccttcccaggctgatgctgggtcctctctctctttggggcttctccctcccgtttcaggggaaaggtctgagtctccacgtttcagaccagcttctgggggaaggcagtccggcagggagaccgggaggggtggccacacagtggggagctgggaggtggggggaatggtcccagactcctctcggggcccctatccacacagggcctggtgttctaccccatctggcccctggcccatctcttctgtgccttagtcacatatgaaagcgcccctccctggctccccatctgtcccacacgctccctggggctcttagttcagctgctggcactcgcaggatcctgcagtgctgggcccagagcccttggacaggcctcaggagtggtcaggaccaccaagcccctcctctccccctccacacctctagacctggggcctccggaacccccagcaggctgggcttatactagctcctgacttaggaagagcctcgtgtcacaacacgtgtccctacaggcaaagtgtcctggcatttaaaacccagattatccctgggtttgggctgcagtcacctggagaagctggtagggtaagggagagggaccctgccggtgttcactggggattctttcttttggtccttcctggaatgaacaggttccctccctgccacctgtgaggagagttggggcccagccgtcttcctggcctccttcctttcctcgtggcagaggcctgcatgtgggtgccagaggccagctctccccctccatcttgggggggcggagcagttgggcccaagctgcccgggagggtgggtgcagacacaggctgaggaccagccctggccctgccccgccatctgctttcaccaagctgtctctccaccgtggcttcccttctccctccaggccaaagtgctgctgattcccactcccttggttttcgcctgcccagcgttgctgtttgcgtggagggtggggggagctcagtggcagggaatcagcggtccgtggggtcgtggggacgggaacatgtgcccgaccgctccatcccctcctcctccttaggatgcataacctaccttgtctttttttttttaaattttctttccaggtagagtagctctttgtacataaagaatacttgaaaaattaattgtatgatgtatgagaagacagagtctcctagttttgtatcttgttgtatgactgccatgagttccaccagaaagccactctattttggtctctgtgacattttaaatgcgtgacagaagtgagcaaataaagtgaggaagaaatcta

SEQ ID NO: 369746 - DNA, 3811 bp, Homo sapiens
gttgggggccggtcgtagctggttttgtgagtggcaagagaacccgggtcgcgccccaacccgcggggcggcgggctggggttcggggcggcgggctggggttcggggcgcggcccctttaaggcccaggcagtgatctcagccgcgtccgccgccccgccctccccggcggcgagcccagagcgcatgcgcgccgcggctgcactccactgggcccgggacgcgccggcggcggcggagactccggggctgcggcgccgcccgccccgcccgcagagtccggctgccgcgcatcgtccgcagacgccgccaccgccatgggctcctgaggctagcttgtcactttctgcaaaggtttccctcagggagcctcctgctgccaggcaccatgacagtgaggggggatgtgctggccccggatccagcgtcgcccacgaccgcagcagcctcgcccagcgtctccgtgatccccgagggcagccccactgccatggagcagcctgtgttcctgatgacaactgccgctcaggccatctctggcttcttcgtgtggacggccctgctcatcacatgccaccagatctacatgcacctgcgctgctacagctgccccaacgagcagcgctacatcgtgcgcatcctcttcatcgtgcccatctacgcctttgactcctggctcagcctcctcttcttcaccaacgaccagtactacgtgtacttcggcaccgtccgcgactgctatgaggccttggtcatctataatttcctgagcctgtgctatgagtacctaggaggagaaagttccatcatgtcggagatcagaggaaaacccattgagtccagctgtatgtatggcacctgctgcctctggggaaagacttattccatcggatttctgaggttctgcaaacaggccaccctgcagttctgtgtggtgaagccactcatggcggtcagcactgtggtcctccaggccttcggcaagtaccgggatggggactttgacgtcaccagtggctacctctacgtgaccatcatctacaacatctccgtcagcctggccctctacgccctcttcctcttctacttcgccacccgggagctgctcagcccctacagccccgtcctcaagttcttcatggtcaagtccgtcatctttctttccttctggcaaggcatgctcctggccatcctggagaagtgtggggccatccccaaaatccactcggcccgcgtgtcggtgggcgagggcaccgtggctgccggctaccaggacttcatcatctgtgtggagatgttctttgcagccctggccctgcggcacgccttcacctacaaggtctatgctgacaagaggctggacgcacaaggccgctgtgcccccatgaagagcatctccagcagcctcaaggagaccatgaacccgcacgacatcgtgcaggacgccatccacaacttctcacctgcctaccagcagtacacgcagcagtccaccctggagcctgggcccacctggcgtggtggcgcccacggcctctcccgctcccacagcctcagtggcgcccgcgacaacgagaagactctcctgctcagctctgatgatgaattctaggtgcgggctgcagtggcggaagtgctggcgccatagccacggtcaggctgtgccccacctccagcctcaccaccaggccaggaggcagctggcacagtgctcacgccgcctttatttattggaccagaaacactcacatgtcacttccagaggaacgggggacagccaggctcgcccatgggccttcaggaatatttatacatggcccagcctgcactgcccgggcgagggcagaggacactgggagcaaggcttatgcccctgctgcccgtcctgtgctgggggcatgctgggaccagccgcacccaggccccaatgcttgtgtgtggaccagcggctgcagccttctagcccctcctccccgcgagactctcaggctgaggtcggcaagccgtggctcccccacacaccgtgcaataccctgtctgacctgggctcttcccgcctgcatccctcccctgtccacctttgtccagtgctagattcacctcaccccgggcaggagtggggatgtgggcgctctgtggtcctcccctcctgacccaggcctctgtggcatgctgcaaggatcagagccagacaccaggagtcacaggccccacccaggaagggcattcagggcccctgggcaccgcttctgttgaagcaggggcttctgggcccctgggtatccccacctgtcgtggccacacctctgcctgcctcatgccccttccccctggcctaccaaggacagcccacagcccgcactgccggctcacttgggtccttcctcgatagctttgggcagagcccttgcttcctggctgcttcagggctcaggggctcccagccctccttcccaggctgatgctgggtcctctctctctttggggcttctccctcccgtttcaggggaaaggtctgagtctccacgtttcagaccagcttctgggggaaggcagtccggcagggagaccgggaggggtggccacacagtggggagctgggaggtggggggaatggtcccagactcctctcggggcccctatccacacagggcctggtgttctaccccatctggcccctggcccatctcttctgtgccttagtcacatatgaaagcgcccctccctggctccccatctgtcccacacgctccctggggctcttagttcagctgctggcactcgcaggatcctgcagtgctgggcccagagcccttggacaggcctcaggagtggtcaggaccaccaagcccctcctctccccctccacacctctagacctggggcctccggaacccccagcaggctgggcttatactagctcctgacttaggaagagcctcgtgtcacaacacgtgtccctacaggcaaagtgtcctggcatttaaaacccagattatccctgggtttgggctgcagtcacctggagaagctggtagggtaagggagagggaccctgccggtgttcactggggattctttcttttggtccttcctggaatgaacaggttccctccctgccacctgtgaggagagttggggcccagccgtcttcctggcctccttcctttcctcgtggcagaggcctgcatgtgggtgccagaggccagctctccccctccatcttgggggggcggagcagttgggcccaagctgcccgggagggtgggtgcagacacaggctgaggaccagccctggccctgccccgccatctgctttcaccaagctgtctctccaccgtggcttcccttctccctccaggccaaagtgctgctgattcccactcccttggttttcgcctgcccagcgttgctgtttgcgtggagggtggggggagctcagtggcagggaatcagcggtccgtggggtcgtggggacgggaacatgtgcccgaccgctccatcccctcctcctccttaggatgcataacctaccttgtctttttttttttaaattttctttccaggtagagtagctctttgtacataaagaatacttgaaaaattaattgtatgatgtatgagaagacagagtctcctagttttgtatcttgttgtatgactgccatgagttccaccagaaagccactctattttggtctctgtgacattttaaatgcgtgacagaagtgagcaaataaagtgaggaagaaatctaaaaaaaaaaaaaaaaaaaaaaaaaaaaaaacaaaacgagtgtgttgcggccgcc

SEQ ID NO: 369747 - DNA, 3633 bp, Homo sapiens
gttgggggccggtcgtagctggttttgtgagtggcaagagaacccgggtcgcgccccaacccgcggggcggcgggctggggttcggggcggcgggctggggttcggggcgcggcccctttaaggcccaggcagtgatctcagccgcgtccgccgccccgccctccccggcggcgagcccagagcgcatgcgcgccgcggctgcactccactgggcccgggacgcgccggcggcggcggagactccggggctgcggcgccgcccgccccgcccgcagagtccggctgccgcgcatcgtccgcagacgccgccaccgccatgggctcctgaggctagcttgtcactttctgcaaaggtttccctcagggagcctcctgctgccaggcaccatgacagtgaggggggatgtgctggccccggatccagcgtcgcccacgaccgcagcagcctcgcccagcgtctccgtgatccccgagggcagccccactgccatggagcagcctgtgttcctgatgacaactgccgctcaggccatctctggcttcttcgtgtggacggccctgctcatcacatgccaccagatctacatgcacctgcgctgctacagctgccccaacgagcagcgctacatcgtgcgcatcctcttcatcgtgcccatctacgcctttgactcctggctcagcctcctcttcttcaccaacgaccagtactacgtgtacttcggcaccgtccgcgactgctatgaggccttggtcatctataatttcctgagcctgtgctatgagtacctaggaggagaaagttccatcatgtcggagatcagaggaaaacccattgagtccagctgtatgtatggcacctgctgcctctggggaaagacttattccatcggatttctgaggttctgcaaacaggccaccctgcagttctgtgtggtgaagccactcatggcggtcagcactgtggtcctccaggccttcggcaagtaccgggatggggactttgacgtcaccagtggctacctctacgtgaccatcatctacaacatctccgtcagcctggccctctacgccctcttcctcttctacttcgccacccgggagctgctcagcccctacagccccgtcctcaagttcttcatggtcaagtccgtcatctttctttccttctggcaaggcatgctcctggccatcctggagaagtgtggggccatccccaaaatccactcggcccgcgtgtcggtgggcgagggcaccgtggctgccggctaccaggacttcatcatctgtgtggagatgttctttgcagccctggccctgcggcacgccttcacctacaaggtctatgctgacaagaggctggacgcacaaggccgctgtgcccccatgaagagcatctccagcagcctcaaggagaccatgaacccgcacgacatcgtgcaggacgccatccacaacttctcacctgcctaccagcagtacacgcagcagtccaccctggagcctgggcccacctggcgtggtggcgcccacggcctctcccgctcccacagcctcagtggcgcccgcgacaacgagaagactctcctgctcagctctgatgatgaattctaggtgcgggctgcagtggcggaagtgctggcgccatagccacggtcaggctgtgccccacctccagcctcaccaccaggccaggaggcagctggcacagtgctcacgccgcctttatttattggaccagaaacactcacatgtcacttccagaggaacgggggacagccaggctcgcccatgggccttcaggaatatttatacatggcccagcctgcactgcccgggcgagggcagaggacactgggagcaaggcttatgcccctgctgcccgtcctgtgctgggggcatgctgggaccagccgcacccaggccccaatgcttgtgtgtggaccagcggctgcagccttctagcccctcctccccgcgagactctcaggctgaggtcggcaagccgtggctcccccacacaccgtgcaataccctgtctgacctgggctcttcccgcctgcatccctcccctgtccacctttgtccagtgctagattcacctcaccccgggcaggagtggggatgtgggcgctctgtggtcctcccctcctgacccaggcctctgtggcatgctgcaaggatcagagccagacaccaggagtcacaggccccacccaggaagggcattcagggcccctgggcaccgcttctgttgaagcaggggcttctgggcccctgggtatccccacctgtcgtggccacacctctgcctgcctcatgccccttccccctggcctaccaaggacagcccacagcccgcactgccggctcacttgggtccttcctcgatagctttgggcagagcccttgcttcctggctgcttcagggctcaggggctcccagccctccttcccaggctgatgctgggtcctctctctctttggggcttctccctcccgtttcaggggaaaggtctgagtctccacgtttcagaccagcttctgggggaaggcagtccggcagggagaccgggaggggtggccacacagtggggagctgggaggtggggggaatggtcccagactcctctcggggcccctatccacacagggcctggtgttctaccccatctggcccctggcccatctcttctgtgccttagtcacatatgaaagcgcccctccctggctccccatctgtcccacacgctccctggggctcttagttcagctgctggcactcgcaggatcctgcagtgctgggcccagagcccttggacaggcctcaggagtggtcaggaccaccaagcccctcctctccccctccacacctctagacctggggcctccggaacccccagcaggctgggcttatactagctcctgacttaggaagagcctcgtgtcacaacacgtgtccctacaggcaaagtgtcctggcatttaaaacccagattatccctgggtttgggctgcagtcacctggagaagctggtagggtaagggagagggaccctgccggtgttcactggggattctttcttttggtccttcctggaatgaacaggttccctccctgccacctgtgaggagagttggggcccagccgtcttcctggcctccttcctttcctcgtggcagaggcctgcatgtgggtgccagaggccagctctccccctccatcttgggggggcggagcagttgggcccaagctgcccgggagggtgggtgcagacacaggctgaggaccagccctggccctgccccgccatctgctttcaccaagctgtctctccaccgtggcttcccttctccctccaggccaaagtgctgctgattcccatcctcctccttaggatgcataacctaccttgtctttttttttttaaattttctttccaggtagagtagctctttgtacataaagaatacttgaaaaattaattgtatgatgtatgagaagacagagtctcctagttttgtatcttgttgtatgactgccatgagttccaccagaaagccactctattttggtctctgtgacattttaaatgcgtgacagaagtgagcaaataaagtgaggaagaaatcta

SEQ ID NO: 369748 - DNA, 956 bp, Homo sapiens
ctcctgacttaggaagagcctcgtgtcacaacacgtgtccctacaggcaaagtgtcctggcatttaaaacccagcctgctggggcctccggaacccccagcaggctgggcttatactagctcctgacttaggaagagcctcgtgtcacaacacgtgtccctacaggcaaagtgtcctggcatttaaaacccagattatccctgggtttgggctgcagtcacctggagaagctggtagggtaagggagagggaccctgccggtgttcactggggattctttcttttggtccttcctggaatgaacaggttccctccctgccacctgtgaggagagttggggcccagccgtcttcctggcctccttcctttcctcgtggcagaggcctgcatgtgggtgccagaggccagctctccccctccatcttgggggggcggagcagttgggcccaagctgcccgggagggtgggtgcagacacaggctgaggaccagccctggccctgccccgccatctgctttcaccaagctgtctctccaccgtggcttcccttctccctccaggccaaagtgctgctgattcccactcccttggttttcgcctgcccagcgttgctgtttgcgtggagggtggggggagctcagtggcagggaatcagcggtccgtggggtcgtggggacgggaacatgtgcccgaccgctccatcccctcctcctccttaggatgcataacctaccttgtctttttttttttaaattttctttccaggtagagtagctctttgtacataaagaatacttgaaaaattaattgtatgatgtatgagaagacagagtctcctagttttgtatcttgttgtatgactgccatgagttccaccagaaagccactctattttggtctctgtgacattttaaatgcgtgacagaagtgagcaaataaagtgaggaagaaatcta

SEQ ID NO: 369749 - DNA, 169 bp, Homo sapiens
gggagctgctcagcccctacagccccgtcctcaagttcttcatggtcaagtccgtcatctttctttccttctggcaaggtgagccccctcccagcacctggaggctgcccatgccaccctgtcctctgcgcttcctgctgccccttctgcttatggtccctggtgcctg

SEQ ID NO: 369750 - DNA, 3757 bp, Homo sapiens
gttgggggccggtcgtagctggttttgtgagtggcaagagaacccgggtcgcgccccaacccgcggggcggcgggctggggttcggggcggcgggctggggttcggggcgcggcccctttaaggcccaggcagtgatctcagccgcgtccgccgccccgccctccccggcggcgagcccagagcgcatgcgcgccgcggctgcactccactgggcccgggacgcgccggcggcggcggagactccggggctgcggcgccgcccgccccgcccgcagagtccggctgccgcgcatcgtccgcagacgccgccaccgccatgggctcctgaggctagcttgtcactttctgcaaaggtttccctcagggagcctcctgctgccaggcaccatgacagtgaggggggatgtgctggccccggatccagcgtcgcccacgaccgcagcagcctcgcccagcgtctccgtgatccccgagggcagccccactgccatggagcagcctgtgttcctgatgacaactgccgctcaggccatctctggcttcttcgtgtggacggccctgctcatcacatgccaccagatctacatgcacctgcgctgctacagctgccccaacgagcagcgctacatcgtgcgcatcctcttcatcgtgcccatctacgcctttgactcctggctcagcctcctcttcttcaccaacgaccagtactacgtgtacttcggcaccgtccgcgactgctatgaggccttggtcatctataatttcctgagcctgtgctatgagtacctaggaggagaaagttccatcatgtcggagatcagaggaaaacccattgagtccagctgtatgtatggcacctgctgcctctggggaaagacttattccatcggatttctgaggttctgcaaacaggccaccctgcagttctgtgtggtgaagccactcatggcggtcagcactgtggtcctccaggccttcggcaagtaccgggatggggactttgacgtcaccagtggctacctctacgtgaccatcatctacaacatctccgtcagcctggccctctacgccctcttcctcttctacttcgccacccgggagctgctcagcccctacagccccgtcctcaagttcttcatggtcaagtccgtcatctttctttccttctggcaaggcatgctcctggccatcctggagaagtgtggggccatccccaaaatccactcggcccgcgtgtcggtgggcgagggcaccgtggctgccggctaccaggacttcatcatctgtgtggagatgttctttgcagccctggccctgcggcacgccttcacctacaaggtctatgctgacaagaggctggacgcacaaggccgctgtgcccccatgaagagcatctccagcagcctcaaggagaccatgaacccgcacgacatcgtgcaggacgccatccacaacttctcacctgcctaccagcagtacacgcagcagtccaccctggagcctgggcccacctggcgtggtggcgcccacggcctctcccgctcccacagcctcagtggcgcccgcgacaacgagaagactctcctgctcagctctgatgatgaattctaggtgcgggctgcagtggcggaagtgctggcgccatagccacggtcaggctgtgccccacctccagcctcaccaccaggccaggaggcagctggcacagtgctcacgccgcctttatttattggaccagaaacactcacatgtcacttccagaggaacgggggacagccaggctcgcccatgggccttcaggaatatttatacatggcccagcctgcactgcccgggcgagggcagaggacactgggagcaaggcttatgcccctgctgcccgtcctgtgctgggggcatgctgggaccagccgcacccaggccccaatgcttgtgtgtggaccagcggctgcagccttctagcccctcctccccgcgagactctcaggctgaggtcggcaagccgtggctcccccacacaccgtgcaataccctgtctgacctgggctcttcccgcctgcatccctcccctgtccacctttgtccagtgctagattcacctcaccccgggcaggagtggggatgtgggcgctctgtggtcctcccctcctgacccaggcctctgtggcatgctgcaaggatcagagccagacaccaggagtcacaggccccacccaggaagggcattcagggcccctgggcaccgcttctgttgaagcaggggcttctgggcccctgggtatccccacctgtcgtggccacacctctgcctgcctcatgccccttccccctggcctaccaaggacagcccacagcccgcactgccggctcacttgggtccttcctcgatagctttgggcagagcccttgcttcctggctgcttcagggctcaggggctcccagccctccttcccaggctgatgctgggtcctctctctctttggggcttctccctcccgtttcaggggaaaggtctgagtctccacgtttcagaccagcttctgggggaaggcagtccggcagggagaccgggaggggtggccacacagtggggagctgggaggtggggggaatggtcccagactcctctcggggcccctatccacacagggcctggtgttctaccccatctggcccctggcccatctcttctgtgccttagtcacatatgaaagcgcccctccctggctccccatctgtcccacacgctccctggggctcttagttcagctgctggcactcgcaggatcctgcagtgctgggcccagagcccttggacaggcctcaggagtggtcaggaccaccaagcccctcctctccccctccacacctctagacctggggcctccggaacccccagcaggctgggcttatactagctcctgacttaggaagagcctcgtgtcacaacacgtgtccctacaggcaaagtgtcctggcatttaaaacccagattatccctgggtttgggctgcagtcacctggagaagctggtagggtaagggagagggaccctgccggtgttcactggggattctttcttttggtccttcctggaatgaacaggttccctccctgccacctgtgaggagagttggggcccagccgtcttcctggcctccttcctttcctcgtggcagaggcctgcatgtgggtgccagaggccagctctccccctccatcttgggggggcggagcagttgggcccaagctgcccgggagggtgggtgcagacacaggctgaggaccagccctggccctgccccgccatctgctttcaccaagctgtctctccaccgtggcttcccttctccctccaggccaaagtgctgctgattcccactcccttggttttcgcctgcccagcgttgctgtttgcgtggagggtggggggagctcagtggcagggaatcagcggtccgtggggtcgtggggacgggaacatgtgcccgaccgctccatcccctcctcctccttaggatgcataacctaccttgtctttttttttttaaattttctttccaggtagagtagctctttgtacataaagaatacttgaaaaattaattgtatgatgtatgagaagacagagtctcctagttttgtatcttgttgtatgactgccatgagttccaccagaaagccactctattttggtctctgtgacattttaaatgcgtgacagaagtgagcaaataaagtgaggaagaaatcta

SEQ ID NO: 369751 - DNA, 542 bp, Homo sapiens
cgactcttagagagatccccgctatcccccttcacatcccgatacaagtgaccagatattcacggtgtacatgtcggtcaccgtccgcgatctgctagtgaggccttggtcatctataatttcctgagcctgtgctatgagtacctaggaggagaaagttccatcatgtcggagatcagaggaaaacccattgagtccagctgtatgtatggcacctgctgcctctggggaaagacttattccatcggatttctgaggttctgcaaacaggccaccctgcagttctgtgtggtgaagccactcatggcggtcagcactgtggtcctccaggccttcggcaagtaccgggatggggactttgacgtcaccagtggctacctctacgtgaccatcatctacaacatctcctacctcggccaggcgcggtggctcacacctgtaatcccagcactgtgggaggccgaggcgggtggatcacctgaggacaggagttcgaggccaccctggccaacatggtgaaaacccgtctctactaaaaatac

SEQ ID NO: 369752 - DNA, 3278 bp, Homo sapiens
cccagggctcggctgggccaagtgtgatgtcatgagagctgggacgagacacccaggggctgcctggactgaggactgtggtagagcagctcttggcatttatctacatgcacctgcgctgctacagctgccccaacgagcagcgctacatcgtgcgcatcctcttcatcgtgcccatctacgcctttgactcctggctcagcctcctcttcttcaccaacgaccagtactacgtgtacttcggcaccgtccgcgactgctatgaggccttggtcatctataatttcctgagcctgtgctatgagtacctaggaggagaaagttccatcatgtcggagatcagaggaaaacccattgagtccagctgtatgtatggcacctgctgcctctggggaaagacttattccatcggatttctgaggttctgcaaacaggccaccctgcagttctgtgtggtgaagccactcatggcggtcagcactgtggtcctccaggccttcggcaagtaccgggatggggactttgacgtcaccagtggctacctctacgtgaccatcatctacaacatctccgtcagcctggccctctacgccctcttcctcttctacttcgccacccgggagctgctcagcccctacagccccgtcctcaagttcttcatggtcaagtccgtcatctttctttccttctggcaaggcatgctcctggccatcctggagaagtgtggggccatccccaaaatccactcggcccgcgtgtcggtgggcgagggcaccgtggctgccggctaccaggacttcatcatctgtgtggagatgttctttgcagccctggccctgcggcacgccttcacctacaaggtctatgctgacaagaggctggacgcacaaggccgctgtgcccccatgaagagcatctccagcagcctcaaggagaccatgaacccgcacgacatcgtgcaggacgccatccacaacttctcacctgcctaccagcagtacacgcagcagtccaccctggagcctgggcccacctggcgtggtggcgcccacggcctctcccgctcccacagcctcagtggcgcccgcgacaacgagaagactctcctgctcagctctgatgatgaattctaggtgcgggctgcagtggcggaagtgctggcgccatagccacggtcaggctgtgccccacctccagcctcaccaccaggccaggaggcagctggcacagtgctcacgccgcctttatttattggaccagaaacactcacatgtcacttccagaggaacgggggacagccaggctcgcccatgggccttcaggaatatttatacatggcccagcctgcactgcccgggcgagggcagaggacactgggagcaaggcttatgcccctgctgcccgtcctgtgctgggggcatgctgggaccagccgcacccaggccccaatgcttgtgtgtggaccagcggctgcagccttctagcccctcctccccgcgagactctcaggctgaggtcggcaagccgtggctcccccacacaccgtgcaataccctgtctgacctgggctcttcccgcctgcatccctcccctgtccacctttgtccagtgctagattcacctcaccccgggcaggagtggggatgtgggcgctctgtggtcctcccctcctgacccaggcctctgtggcatgctgcaaggatcagagccagacaccaggagtcacaggccccacccaggaagggcattcagggcccctgggcaccgcttctgttgaagcaggggcttctgggcccctgggtatccccacctgtcgtggccacacctctgcctgcctcatgccccttccccctggcctaccaaggacagcccacagcccgcactgccggctcacttgggtccttcctcgatagctttgggcagagcccttgcttcctggctgcttcagggctcaggggctcccagccctccttcccaggctgatgctgggtcctctctctctttggggcttctccctcccgtttcaggggaaaggtctgagtctccacgtttcagaccagcttctgggggaaggcagtccggcagggagaccgggaggggtggccacacagtggggagctgggaggtggggggaatggtcccagactcctctcggggcccctatccacacagggcctggtgttctaccccatctggcccctggcccatctcttctgtgccttagtcacatatgaaagcgcccctccctggctccccatctgtcccacacgctccctggggctcttagttcagctgctggcactcgcaggatcctgcagtgctgggcccagagcccttggacaggcctcaggagtggtcaggaccaccaagcccctcctctccccctccacacctctagacctggggcctccggaacccccagcaggctgggcttatactagctcctgacttaggaagagcctcgtgtcacaacacgtgtccctacaggcaaagtgtcctggcatttaaaacccagattatccctgggtttgggctgcagtcacctggagaagctggtagggtaagggagagggaccctgccggtgttcactggggattctttcttttggtccttcctggaatgaacaggttccctccctgccacctgtgaggagagttggggcccagccgtcttcctggcctccttcctttcctcgtggcagaggcctgcatgtgggtgccagaggccagctctccccctccatcttgggggggcggagcagttgggcccaagctgcccgggagggtgggtgcagacacaggctgaggaccagccctggccctgccccgccatctgctttcaccaagctgtctctccaccgtggcttcccttctccctccaggccaaagtgctgctgattcccactcccttggttttcgcctgcccagcgttgctgtttgcgtggagggtggggggagctcagtggcagggaatcagcggtccgtggggtcgtggggacgggaacatgtgcccgaccgctccatcccctcctcctccttaggatgcataacctaccttgtctttttttttttaaattttctttccaggtagagtagctctttgtacataaagaatacttgaaaaattaattgtatgatgtatgagaagacagagtctcctagttttgtatcttgttgtatgactgccatgagttccaccagaaagccactctattttggtctctgtgacattttaaatgcgtgacagaagtgagcaaataaagtgaggaagaaatcta

SEQ ID NO: 369753 - DNA, 3814 bp, Homo sapiens
gttgggggccggtcgtagctggttttgtgagtggcaagagaacccgggtcgcgccccaacccgcggggcggcgggctggggttcggggcggcgggctggggttcggggcgcggcccctttaaggcccaggcagtgatctcagccgcgtccgccgccccgccctccccggcggcgagcccagagcgcatgcgcgccgcggctgcactccactgggcccgggacgcgccggcggcggcggagactccggggctgcggcgccgcccgccccgcccgcagagtccggctgccgcgcatcgtccgcagacgccgccaccgccatgggctcctgaggctagcttgtcactttctgcaaaggtttccctcagggagcctcctgctgccaggcaccatgacagtgaggggggatgtgctggccccggatccagcgtcgcccacgaccgcagcagcctcgcccagcgtctccgtgatccccgagggcagccccactgccatggagcagcctgtgttcctgatgacaactgccgctcaggccatctctggcttcttcgtgtggacggccctgctcatcacatgccaccagatctacatgcacctgcgctgctacagctgccccaacgagcagcgctacatcgtgcgcatcctcttcatcgtgcccatctacgcctttgactcctggctcagcctcctcttcttcaccaacgaccagtactacgtgtacttcggcaccgtccgcgactgctatgaggccttggtcatctataatttcctgagcctgtgctatgagtacctaggaggagaaagttccatcatgtcggagatcagaggaaaacccattgagtccagctgtatgtatggcacctgctgcctctggggaaagacttattccatcggatttctgaggttctgcaaacaggccaccctgcagttctgtgtggtgaagccactcatggcggtcagcactgtggtcctccaggccttcggcaagtaccgggatggggactttgacgtcaccagtggctacctctacgtgaccatcatctacaacatctccgtcagcctggccctctacgccctcttcctcttctacttcgccacccgggagctgctcagcccctacagccccgtcctcaagttcttcatggtcaagtccgtcatctttctttccttctggcaaggcatgctcctggccatcctggagaagtgtggggccatccccaaaatccactcggcccgcgtgtcggtgggcgagggcaccgtggctgccggctaccaggacttcatcatctgtgtggagatgttctttgcagccctggccctgcggcacgccttcacctacaaggtctatgctgacaagaggctggacgcacaagtgccaacatacggcccttacgcctcctcacctgcccctcccgctccctgcccggcaggccgctgtgcccccatgaagagcatctccagcagcctcaaggagaccatgaacccgcacgacatcgtgcaggacgccatccacaacttctcacctgcctaccagcagtacacgcagcagtccaccctggagcctgggcccacctggcgtggtggcgcccacggcctctcccgctcccacagcctcagtggcgcccgcgacaacgagaagactctcctgctcagctctgatgatgaattctaggtgcgggctgcagtggcggaagtgctggcgccatagccacggtcaggctgtgccccacctccagcctcaccaccaggccaggaggcagctggcacagtgctcacgccgcctttatttattggaccagaaacactcacatgtcacttccagaggaacgggggacagccaggctcgcccatgggccttcaggaatatttatacatggcccagcctgcactgcccgggcgagggcagaggacactgggagcaaggcttatgcccctgctgcccgtcctgtgctgggggcatgctgggaccagccgcacccaggccccaatgcttgtgtgtggaccagcggctgcagccttctagcccctcctccccgcgagactctcaggctgaggtcggcaagccgtggctcccccacacaccgtgcaataccctgtctgacctgggctcttcccgcctgcatccctcccctgtccacctttgtccagtgctagattcacctcaccccgggcaggagtggggatgtgggcgctctgtggtcctcccctcctgacccaggcctctgtggcatgctgcaaggatcagagccagacaccaggagtcacaggccccacccaggaagggcattcagggcccctgggcaccgcttctgttgaagcaggggcttctgggcccctgggtatccccacctgtcgtggccacacctctgcctgcctcatgccccttccccctggcctaccaaggacagcccacagcccgcactgccggctcacttgggtccttcctcgatagctttgggcagagcccttgcttcctggctgcttcagggctcaggggctcccagccctccttcccaggctgatgctgggtcctctctctctttggggcttctccctcccgtttcaggggaaaggtctgagtctccacgtttcagaccagcttctgggggaaggcagtccggcagggagaccgggaggggtggccacacagtggggagctgggaggtggggggaatggtcccagactcctctcggggcccctatccacacagggcctggtgttctaccccatctggcccctggcccatctcttctgtgccttagtcacatatgaaagcgcccctccctggctccccatctgtcccacacgctccctggggctcttagttcagctgctggcactcgcaggatcctgcagtgctgggcccagagcccttggacaggcctcaggagtggtcaggaccaccaagcccctcctctccccctccacacctctagacctggggcctccggaacccccagcaggctgggcttatactagctcctgacttaggaagagcctcgtgtcacaacacgtgtccctacaggcaaagtgtcctggcatttaaaacccagattatccctgggtttgggctgcagtcacctggagaagctggtagggtaagggagagggaccctgccggtgttcactggggattctttcttttggtccttcctggaatgaacaggttccctccctgccacctgtgaggagagttggggcccagccgtcttcctggcctccttcctttcctcgtggcagaggcctgcatgtgggtgccagaggccagctctccccctccatcttgggggggcggagcagttgggcccaagctgcccgggagggtgggtgcagacacaggctgaggaccagccctggccctgccccgccatctgctttcaccaagctgtctctccaccgtggcttcccttctccctccaggccaaagtgctgctgattcccactcccttggttttcgcctgcccagcgttgctgtttgcgtggagggtggggggagctcagtggcagggaatcagcggtccgtggggtcgtggggacgggaacatgtgcccgaccgctccatcccctcctcctccttaggatgcataacctaccttgtctttttttttttaaattttctttccaggtagagtagctctttgtacataaagaatacttgaaaaattaattgtatgatgtatgagaagacagagtctcctagttttgtatcttgttgtatgactgccatgagttccaccagaaagccactctattttggtctctgtgacattttaaatgcgtgacagaagtgagcaaataaagtgaggaagaaatcta

SEQ ID NO: 369754 - DNA, 3790 bp, Homo sapiens
gttgggggccggtcgtagctggttttgtgagtggcaagagaacccgggtcgcgccccaacccgcggggcggcgggctggggttcggggcggcgggctggggttcggggcgcggcccctttaaggcccaggcagtgatctcagccgcgtccgccgccccgccctccccggcggcgagcccagagcgcatgcgcgccgcggctgcactccactgggcccgggacgcgccggcggcggcggagactccggggctgcggcgccgcccgccccgcccgcagagtccggctgccgcgcatcgtccgcagacgccgccaccgccatgggctcctgaggctagcttgtcactttctgcaaaggtttccctcagggagcctcctgctgccaggcaccatgacagtgaggggggatgtgctggccccggatccagcgtcgcccacgaccgcagcagcctcgcccagcgtctccgtgatccccgagggcagccccactgccatggagcagcctgtgttcctgatgacaactgccgctcaggccatctctggcttcttcgtgtggacggccctgctcatcacatgccaccagatctacatgcacctgcgctgctacagctgccccaacgagcagcgctacatcgtgcgcatcctcttcatcgtgcccatctacgcctttgactcctggctcagcctcctcttcttcaccaacgaccagtactacgtgtacttcggcaccgtccgcgactgctatgaggccttggtcatctataatttcctgagcctgtgctatgagtacctaggaggagaaagttccatcatgtcggagatcagaggaaaacccattgagtccagctgtatgtatggcacctgctgcctctggggaaagacttattccatcggatttctgaggttctgcaaacaggccaccctgcagttctgtgtggtgaagccactcatggcggtcagcactgtggtcctccaggccttcggcaagtaccgggatggggactttgacgtcaccagtggctacctctacgtgaccatcatctacaacatctccgtcagcctggccctctacgccctcttcctcttctacttcgccacccgggagctgctcagcccctacagccccgtcctcaagttcttcatggtcaagtccgtcatctttctttccttctggcaaggcatgctcctggccatcctggagaagtgtggggccatccccaaaatccactcggcccgcgtgtcggtgggcgagggcaccgtggctgccggctaccaggacttcatcatctgtgtggagatgttctttgcagccctggccctgcggcacgccttcacctacaaggtctatgctgacaagaggctggacgcacaaggccgctgtgcccccatgaagagcatctccagcagcctcaaggagaccatgaacccgcacgacatcgtgcaggacgccatccacaacttctcacctgcctaccagcagtacacgcagcagtccaccctggagcctgggcccacctggcgtggtggcgcccacggcctctcccgctcccacagcctcagtggcgcccgcgacaacgagaagactctcctgctcagctctgatgatgaattctaggtgcgggctgcagtggcggaagtgctggcgccatagccacggtcaggctgtgccccacctccagcctcaccaccaggccaggaggcagctggcacagtgctcacgccgcctttatttattggaccagaaacactcacatgtcacttccagaggaacgggggacagccaggctcgcccatgggccttcaggaatatttatacatggcccagcctgcactgcccgggcgagggcagaggacactgggagcaaggcttatgcccctgctgcccgtcctgtgctgggggcatgctgggaccagccgcacccaggccccaatgcttgtgtgtggaccagcggctgcagccttctagcccctcctccccgcgagactctcaggctgaggtcggcaagccgtggctcccccacacaccgtgcaataccctgtctgacctgggctcttcccgcctgcatccctcccctgtccacctttgtccagtgctagattcacctcaccccgggcaggagtggggatgtgggcgctctgtggtcctcccctcctgacccaggcctctgtggcatgctgcaaggatcagagccagacaccaggagtcacaggccccacccaggaagggcattcagggcccctgggcaccgcttctgttgaagcaggggcttctgggcccctgggtatccccacctgtcgtggccacacctctgcctgcctcatgccccttccccctggcctaccaaggacagcccacagcccgcactgccggctcacttgggtccttcctcgatagctttgggcagagcccttgcttcctggctgcttcagggctcaggggctcccagccctccttcccaggctgatgctgggtcctctctctctttggggcttctccctcccgtttcaggggaaaggtctgagtctccacgtttcagaccagcttctgggggaaggcagtccggcagggagaccgggaggggtggccacacagtggggagctgggaggtggggggaatggtcccagactcctctcggggcccctatccacacagggcctggtgttctaccccatctggcccctggcccatctcttctgtgccttagtcacatatgaaagcgcccctccctggctccccatctgtcccacacgctccctggggctcttagttcagctgctggcactcgcaggatcctgcagtgctgggcccagagcccttggacaggcctcaggagtggtcaggaccaccaagcccctcctctccccctccacacctctagacctggggcctccggaacccccagcaggctgggcttatactagctcctgacttaggaagagcctcgtgtcacaacacgtgtccctacaggcaaagtgtcctggcatttaaaacccagattatccctgggtttgggctgcagtcacctggagaagctggtagggtaagggagagggaccctgccggtgttcactggggattctttcttttggtccttcctggaatgaacaggttccctccctgccacctgtgaggagagttggggcccagccgtcttcctggcctccttcctttcctcgtggcagaggcctgcatgtgggtgccagaggccagctctccccctccatcttgggggggcggagcagttgggcccaagctgcccgggagggtgggtgcagacacaggctgaggaccagccctggccctgccccgccatctgctttcaccaagctgtctctccaccgtggcttcccttctccctccaggccaaagtgctgctgattcccactcccttggttttcgcctgcccagcgttgctgtttgcgtggagggtggggggagctcagtggcagggaatcagcggtccgtggggtcgtggggacgggaacatgtgcccgaccgctccatcccctcctcctccttaggatgcataacctaccttgtctttttttttttaaattttctttccaggtagagtagctctttgtacataaagaatacttgaaaaattaattgtatgatgtatgagaagacagagtctcctagttttgtatcttgttgtatgactgccatgagttccaccagaaagccactctattttggtctctgtgacattttaaatgcgtgacagaagtgagcaaataaagtgaggaagaaatctatatatgagataatatagattgtattgaaatctc

SEQ ID NO: 369755 - DNA, 1697 bp, Homo sapiens
gttgggggccggtcgtagctggttttgtgagtggcaagagaacccgggtcgcgccccaacccgcggggcggcgggctggggttcggggcggcgggctggggttcggggcgcggcccctttaaggcccaggcagtgatctcagccgcgtccgccgccccgccctccccggcggcgagcccagagcgcatgcgcgccgcggctgcactccactgggcccgggacgcgccggcggcggcggagactccggggctgcggcgccgcccgccccgcccgcagagtccggctgccgcgcatcgtccgcagacgccgccaccgccatgggctcctgaggctagcttgtcactttctgcaaaggtttccctcagggagcctcctgctgccaggcaccatgacagtgaggggggatgtgctggccccggatccagcgtcgcccacgaccgcagcagcctcgcccagcgtctccgtgatccccgagggcagccccactgccatggagcagcctgtgttcctgatgacaactgccgctcaggccatctctggcttcttcgtgtggacggccctgctcatcacatgccaccagatctacatgcacctgcgctgctacagctgccccaacgagcagcgctacatcgtgcgcatcctcttcatcgtgcccatctacgcctttgactcctggctcagcctcctcttcttcaccaacgaccagtactacgtgtacttcggcaccgtccgcgactgctatgaggccttggtcatctataatttcctgagcctgtgctatgagtacctaggaggagaaagttccatcatgtcggagatcagaggaaaacccattgagtccagctgtatgtatggcacctgctgcctctggggaaagacttattccatcggatttctgaggttctgcaaacaggccaccctgcagttctgtgtggtgaagccactcatggcggtcagcactgtggtcctccaggccttcggcaagtaccgggatggggactttgagtaagcagcgggtgctccccggggtgtgtgggaggagtgttggcgcaggctggtgccttggctcagggaagggggcagccagagtggccgcacagccatgaccttcctgggtgtctggtgctcacaacccccctgaagtctgagcccagcagtggacacccttgcagttggccccgctgccagcccctgagtgagccattggcagcagtcacgttcatgtccaggctgcagagtggtaccatgaagggatgggccacaaagggacagtgaccactgctgaggcagggagcgagagggtcagagccccaagaggtcggctcaagtccacagatacaaagcccgtgctgtgtaaattgtccacacccatttcattctgggcttagtgaaagtgaccccgtggctgggcacagtggttcacgcctgtaatcctagcactttgggaggccaacgcgggtagatcacctgaggtcaggagttcaagaccagcctggccaacatggtgaaaccccatcactactaaaaatacaaaaaattaaccgggcgtggtgacgggtgcctataatcccagctactcgggaggctgaggcaggagaatcgcttgaacccaggaggcagaggttgcggtgagccaagatcacgccattgcactctagcctgggtgacaagaacaaaactccatatctaaaaaaaaa

SEQ ID NO: 369756 - DNA, 639 bp, Homo sapiens
gaggctctggaagtctgaggagggaaagagaaaagatagagtggcatctagacaggttaattaaatgagtgctgtagtttccagacccttttgctgttttaagtctggaagggagggggtaacatggatactgtatgtagaaaaacttttccctggtgaaacatagacgtatgagtggatgctgcgccattagatattttgttctcattgtgtgctagttaagggaaagggccaaatgtagaatttggaggatagtgctggtctgctgtaaccactttcctcccagttttttctaaaggtgaaagttaacgttaatattgtaacaaaataggaataaggaattgtggaggaagatgagaagctgccagagggtaattggttttcccagaagttcttaaatttgggagctgtcttgccgcaagccattgagactggaaattcttggagttggtattgtttttgtaaattgactaatagagagttagggaagcctggagacttgttgggggtgagttctctaaatggttttaggcttgtctgtgtacttttgcaacgagattgtctaattctatgggcctctgaggtttcaaagtaaaacttgaaaattaattattttcccctccttatttgtttttgttt

SEQ ID NO: 369757 - DNA, 732 bp, Homo sapiens
gaggctctggaagtctgaggagggaaagagaaaagatagagtggcatctagacaggttaattaaatgagtgctgtagtttccagacccttttgctgttttaagtctggaagggagggggtaacatggatactgtatgtagaaaaacttttccctggtgaaacatagacgtatgagtggatgctgcgccattagatattttgttctcattgtgtgctagttaagggaaagggccaaatgtagaatttggaggatagtgctggtctgctgtaaccactttcctcccagttttttctaaaggtgaaagttaacgttaatattgtaacaaaataggaataaggaattgtggaggaagatgagaagctgccagagggtaattggttttcccagaagttcttaaatttgggagctgtcttgccgcaagccattgagactggaaattcttggagttggtattgtttttgtaaattgactaatagagagttagggaagcctggagacttgttgggggtgagttctctaaatggttttaggcttgtctgtgtacttttgcaacgagattgtctagaactggagcttagtccagctggtacaataccaactccccttctagttcccaaaggcgatgtccagacacagactttatgattattatatttttcaatgccagtgctgctcagccctcagcagaacttcagtttccatgaaataaacaatgactatataaaattcca

SEQ ID NO: 369758 - DNA, 2450 bp, Homo sapiens
tccggctcatgtctcactatggcctcgaagccgccactaaccggccgggttccgggaggcgccgttcaggatgcagccacccccgcccgcctgtcccctcccccacggccgcggcggcggcggcggcggcggctgctggagcccggatgcggcgccgtgaggcaggcccgggagagcggcgcggatggatccaacatggcggcgccgagcctgagccgagagaagagacctgggaaattaagtttcttgcggagtacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagtgcctccccactatcctgtggtgtgttgccccacttcgggtcctcagatgtgtagcaagcggccagcccgagggagagccacacttgggagccagcgaaaacgccggaagtcagtgacaccagatcccaaggagaagcagacatgtgacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctgcctttttttttttttttttaaagaaaaagacaaaagaaagtggaagtggtattccccacccctccctgcacccatgtgcctgggcttcccctttatttcccttttccatttaccccgtaatgtgtctctacagctaccttaccactgagccgtaagacaaatgtataggaagaagcaaagtctacagcacatagtctttgtaagggattgatgtgaacacttttttttggatgcactaaggagttatcaatacttctggctttatgagagctcttaaattttgtctaaaaaaccaaagggctgtgagtaagggagctatgtggaaagtgggactctgaagtgtattttgaaaattaatcgccaccctcttccaaattatagaattttttaaaaacaagctgtggccctttccactctctcctggcctctggtgctgctcctctctgccgcctttcctccattccatggcttgaaacctctgcctgatgtggctccttcctttttcccatttgtcaaaccctcttcaaaggaggaacagataagactgggtcagcctagtcatgcctcccaactgtggtggtatatgtgtacacacatacacagggtggatggagaagaggttgctgattaaaatacactccccctataaaggggaagggggagtgtgacactttctttccatgttcaagtgaaaataaataatgtaccctgcagcccttttcccctttgctttcttctggcttgggcaaagggcatcataggtgtaagtgaagtaattcctttttccttccccctcctccactcctacgcccactcccatgcttgggagaatggggctgggacatgcactgagtgttgcacttttatttaggtagggaggcatgttgaatgagccaggaggtctagaactggagcttagtccagctggtacaataccaactccccttctagttcccaaaggcgatgtccagacacagactttatgattattatatttttcaatgccagtgctgctcagccctcagcagaacttcagtttccatgaaataaacaatgactatataaaattcca

SEQ ID NO: 369759 - DNA, 2778 bp, Homo sapiens
  misc_feature (351)..(351): n is a, c, g, or t
  misc_feature (356)..(356): n is a, c, g, or t
  misc_feature (363)..(364): n is a, c, g, or t
ccttccttgttggactccagtcggaaccaatcgttgtcagcattcttgttgttctccacataccggataagggactgatattcctccttcagtcgctgcacccacaactcacgatctcggggtccggcgttagtcttcagcaccgggatctcagacacaacacgtcgcgtggcttcatccgccatcttggaccagggcgcaagagaaacgcggaagtggtgttgcctgtagcttacctcaaggcgccgtcatcttttaaataattgggctacctcccccggggcccttccaaaattgggttccctgccaaccttaaaaattgggggggtcccccgttccccggaaaaaacnggccncagccannctaaccggccgggttccgggaggcgccgttcaggatgcagccacccccgcccgcctgtcccctcccccacggccgcggcggcggcggcggcggcggctgctggagcccggatgcggcgccgtgaggcaggcccgggagagcggcgcggatggatccaacatggcggcgccgagcctgagccgagagaagagacctgggaaattaagtttcttgcggagtacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagtgcctccccactatcctgtggtgtgttgccccacttcgggtcctcagatgtgtagcaagcggccagcccgagggagagccacacttgggagccagcgaaaacgccggaagtcagtgacaccagatcccaaggagaagcagacatgtgacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctgcctttttttttttttttttaaagaaaaagacaaaagaaagtggaagtggtattccccacccctccctgcacccatgtgcctgggcttcccctttatttcccttttccatttaccccgtaatgtgtctctacagctaccttaccactgagccgtaagacaaatgtataggaagaagcaaagtctacagcacatagtctttgtaagggattgatgtgaacacttttttttggatgcactaaggagttatcaatacttctggctttatgagagctcttaaattttgtctaaaaaaccaaagggctgtgagtaagggagctatgtggaaagtgggactctgaagtgtattttgaaaattaatcgccaccctcttccaaattatagaattttttaaaaacaagctgtggccctttccactctctcctggcctctggtgctgctcctctctgccgcctttcctccattccatggcttgaaacctctgcctgatgtggctccttcctttttcccatttgtcaaaccctcttcaaaggaggaacagataagactgggtcagcctagtcatgcctcccaactgtggtggtatatgtgtacacacatacacagggtggatggagaagaggttgctgattaaaatacactccccctataaaggggaagggggagtgtgacactttctttccatgttcaagtgaaaataaataatgtaccctgcagcccttttcccctttgctttcttctggcttgggcaaagggcatcataggtgtaagtgaagtaattcctttttccttccccctcctccactcctacgcccactcccatgcttgggagaatggggctgggacatgcactgagtgttgcacttttatttaggtagggaggcatgttgaatgagccaggaggtctagaactggagcttagtccagctggtacaataccaactccccttctagttcccaaaggcgatgtccagacacagactttatgattattatatttttcaatgccagtgctgctcagccctcagcagaacttcagtttccatgaaataaacaatgactatataaaattcca

SEQ ID NO: 369760 - DNA, 2386 bp, Homo sapiens
  misc_feature (351)..(351): n is a, c, g, or t
  misc_feature (356)..(356): n is a, c, g, or t
  misc_feature (363)..(364): n is a, c, g, or t
ccttccttgttggactccagtcggaaccaatcgttgtcagcattcttgttgttctccacataccggataagggactgatattcctccttcagtcgctgcacccacaactcacgatctcggggtccggcgttagtcttcagcaccgggatctcagacacaacacgtcgcgtggcttcatccgccatcttggaccagggcgcaagagaaacgcggaagtggtgttgcctgtagcttacctcaaggcgccgtcatcttttaaataattgggctacctcccccggggcccttccaaaattgggttccctgccaaccttaaaaattgggggggtcccccgttccccggaaaaaacnggccncagccannctaaccggccgggttccgggaggcgccgttcaggatgcagccacccccgcccgcctgtcccctcccccacggccgcggcggcggcggcggcggcggctgctggagcccggatgcggcgccgtgaggcaggcccgggagagcggcgcggatggatccaacatggcggcgccgagcctgagccgagatacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagtgcctccccactatcctgtggtgtgttgccccacttcgggtcctcagatgtgtagcaagcggccagcccgagggagagccacacttgggagccagcgaaaacgccggaagtcagtgacaccagatcccaaggagaagcagacatgtgacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctgcctttttttttttttttttaaagaaaaagacaaaagaaagtggaagtggtattccccacccctccctgcacccatgtgcctgggcttcccctttatttcccttttccatttaccccgtaatgtgtctctacagctaccttaccactgagccgtaagacaaatgtataggaagaagcaaagtctacagcacatagtctttgtaagggattgatgtgaacacttttttttggatgcactaaggagttatcaatacttctggctttatgagagctcttaaattttgtctaaaaaaccaaagggctgtgagtaagggagctatgtggaaagtgggactctgaagtgtattttgaaaattaatcgccaccctcttccaaattatagaattttttaaaaacaagctgtggccctttccactctctcctggcctctggtgctgctcctctctgccgcctttcctccattccatggcttgaaacctctgcctgatgtggctccttcctttttcccatttgtcaaaccctcttcaaaggaggaacagataagactgggtcagcctagtcatgcctcccaactgtggtggtatatgtgtacacacatacacagggtggatggagaagaggttgctgattaaaatacactccccctataaaggggaagggggagtgtgacactttctttccatgttcaagtgaaaataaataatgtaccctgca

SEQ ID NO: 369761 - DNA, 1948 bp, Homo sapiens
gaaggaaagtggagggggaggcggtggagacgtccagcctgagaacctcaagagagggaggtgacgggacgctgagaggaagagacctgggaaattaagtttcttgcggagtacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagtgcctccccactatcctgtggtgtgttgccccacttcgggtcctcagatgtgtagcaagcggccagcccgagggagagccacacttgggagccagcgaaaacgccggaagtcagtgacaccagatcccaaggagaagcagacatgtgacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctgcctttttttttttttttttaaagaaaaagacaaaagaaagtggaagtggtattccccacccctccctgcacccatgtgcctgggcttcccctttatttcccttttccatttaccccgtaatgtgtctctacagctaccttaccactgagccgtaagacaaatgtataggaagaagcaaagtctacagcacatagtctttgtaagggattgatgtgaacacttttttttggatgcactaaggagttatcaatacttctggctttatgagagctcttaaattttgtctaaaaaaccaaagggctgtgagtaagggagctatgtggaaagtgggactctgaagtgtattttgaaaattaatcgccaccctcttccaaattatagaattttttaaaaacaagctgtggccctttccactctctcctggcctctggtgctgctcctctctgccgcctttcctccattccatggcttgaaacctctgcctgatgtggctccttcctttttcccatttgtcaaaccctcttcaaaggaggaacagataagactgggtcagcctagtcatgcctcccaactgtggtggtatatgtgtacacacatacacagggtggatggagaagaggttgctgattaaaatacactccccctataaaggggaagggggagtgtgacactttctttccatgttcaagtgaaaataaataatgtaccctgca

SEQ ID NO: 369762 - DNA, 1896 bp, Homo sapiens
tgggcgatccgctcgtattgaagggggaagagacctgggaaattaagtttcttgcggagtacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagtgcctccccactatcctgtggtgtgttgccccacttcgggtcctcagatgtgtagcaagcggccagcccgagggagagccacacttgggagccagcgaaaacgccggaagtcagtgacaccagatcccaaggagaagcagacatgtgacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctgcctttttttttttttttttaaagaaaaagacaaaagaaagtggaagtggtattccccacccctccctgcacccatgtgcctgggcttcccctttatttcccttttccatttaccccgtaatgtgtctctacagctaccttaccactgagccgtaagacaaatgtataggaagaagcaaagtctacagcacatagtctttgtaagggattgatgtgaacacttttttttggatgcactaaggagttatcaatacttctggctttatgagagctcttaaattttgtctaaaaaaccaaagggctgtgagtaagggagctatgtggaaagtgggactctgaagtgtattttgaaaattaatcgccaccctcttccaaattatagaattttttaaaaacaagctgtggccctttccactctctcctggcctctggtgctgctcctctctgccgcctttcctccattccatggcttgaaacctctgcctgatgtggctccttcctttttcccatttgtcaaaccctcttcaaaggaggaacagataagactgggtcagcctagtcatgcctcccaactgtggtggtatatgtgtacacacatacacagggtggatggagaagaggttgctgattaaaatacactccccctataaaggggaagggggagtgtgacactttctttccatgttcaagtgaaaataaataatgtaccctgca

SEQ ID NO: 369763 - DNA, 2043 bp, Homo sapiens
tccggctcatgtctcactatggcctcgaagccgccactaaccggccgggttccgggaggcgccgttcaggatgcagccacccccgcccgcctgtcccctcccccacggccgcggcggcggcggcggcggcggctgctggagcccggatgcggcgccgtgaggcaggcccgggagagcggcgcggatggatccaacatggcggcgccgagcctgagccgagagaagagacctgggaaattaagtttcttgcggagtacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagtgcctccccactatcctgtggtgtgttgccccacttcgggtcctcagatgtgtagcaagcggccagcccgagggagagccacacttgggagccagcgaaaacgccggaagtcagtgacaccagatcccaaggagaagcagacatgtgacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctgcctttcttatgatattcttattttaaaaggaaaaacagacaaagagacacggtggaaggtggatatttccccaaacccatcaccgtgacaccacatgtgtgtgccgggagacttccccattagatatgccacttaatcacattattacccgcgagaagagggtggtccctccctagcggagacgatacccgtgtcccacgaacgtgggagcgccgggtagatgaaaacaccacgtgtggatctatgcgggaaacgcaacagcacacaagagttcttaccacgggccaacgagttagggctccgttgtgggcttagcggggaattctggacgtgcgtgcaccaccacctctcttacagagtggggaagtggcaccaacaggagggaacgacataagactcagagacgacaaaaccgatgctcggtggaggaccgtctagcagacgacaagaaaaggacacccataaggaaacactcgacgcgggcccgataacaacacaagaccccccccagaggggggcccgtgcaagagaagacatacacggaggggacagaccccatatcgagggcagcaacaacacaggcgtgggggcgacgcctgcccgaaacaacgagaggagaatactccacgggggcacaacaacacttagtaaccacagccggagaa

SEQ ID NO: 369764 - DNA, 2046 bp, Homo sapiens
tccggctcatgtctcactatggcctcgaagccgccactaaccggccgggttccgggaggcgccgttcaggatgcagccacccccgcccgcctgtcccctcccccacggccgcggcggcggcggcggcggcggctgctggagcccggatgcggcgccgtgaggcaggcccgggagagcggcgcggatggatccaacatggcggcgccgagcctgagccgagagaagagacctgggaaattaagtttcttgcggagtacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagtgcctccccactatcctgtggtgtgttgccccacttcgggtcctcagatgtgtagcaagcggccagcccgagggagagccacacttgggagccagcgaaaacacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctgcctttttttttttttttttaaagaaaaagacaaaagaaagtggaagtggtattccccacccctccctgcacccatgtgcctgggcttcccctttatttcccttttccatttaccccgtaatgtgtctctacagctaccttaccactgagccgtaagacaaatgtataggaagaagcaaagtctacagcacatagtctttgtaagggattgatgtgaacacttttttttggatgcactaaggagttatcaatacttctggctttatgagagctcttaaattttgtctaaaaaaccaaagggctgtgagtaagggagctatgtggaaagtgggactctgaagtgtattttgaaaattaatcgccaccctcttccaaattatagaattttttaaaaacaagctgtggccctttccactctctcctggcctctggtgctgctcctctctgccgcctttcctccattccatggcttgaaacctctgcctgatgtggctccttcctttttcccatttgtcaaaccctcttcaaaggaggaacagataagactgggtcagcctagtcatgcctcccaactgtggtggtatatgtgtacacacatacacagggtggatggagaagaggttgctgattaaaatacactccccctataaaggggaagggggagtgtgacactttctttccatgttcaagtgaaaataaataatgtaccctgca

SEQ ID NO: 369765 - DNA, 2056 bp, Homo sapiens
  misc_feature (351)..(351): n is a, c, g, or t
  misc_feature (356)..(356): n is a, c, g, or t
  misc_feature (363)..(364): n is a, c, g, or t
ccttccttgttggactccagtcggaaccaatcgttgtcagcattcttgttgttctccacataccggataagggactgatattcctccttcagtcgctgcacccacaactcacgatctcggggtccggcgttagtcttcagcaccgggatctcagacacaacacgtcgcgtggcttcatccgccatcttggaccagggcgcaagagaaacgcggaagtggtgttgcctgtagcttacctcaaggcgccgtcatcttttaaataattgggctacctcccccggggcccttccaaaattgggttccctgccaaccttaaaaattgggggggtcccccgttccccggaaaaaacnggccncagccannctaaccggccgggttccgggaggcgccgttcaggatgcagccacccccgcccgcctgtcccctcccccacggccgcggcggcggcggcggcggcggctgctggagcccggatgcggcgccgtgaggcaggcccgggagagcggcgcggatggatccaacatggcggcgccgagcctgagccgagagaagagacctgggaaattaagtttcttgcggaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagatgtgtagcaagcggccagcccgagggagagccacacttgggagccagcgaaaacgccggaagtcagtgacaccagatcccaaggagaagcagacatgtgacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctgcctttttttttttttttttaaagaaaaagacaaaagaaagtggaagtggtattccccacccctccctgcacccatgtgcctgggcttcccctttatttcccttttccatttaccccgtaatgtgtctctacagctaccttaccactgagccgtaagacaaatgtataggaagaagcaaagtctacagcacatagtctttgtaagggattgatgtgaacacttttttttggatgcactaaggagttatcaatacttctggctttatgagagctcttaaattttgtctaaaaaaccaaagggctgtgagtaagggagctatgtggaaagtgggactctgaagtgtattttgaaaattaatcgccaccctcttccaaattatagaattttttaaaaacaagctgtggccctttccactctctcctggcctctggtgctgctcctctctgccgcctttcctccattccatggcttgaaacctctgcctgatgtggctccttcctttttcccatttgtcaaaccctcttcaaaggaggaacagataagactgggtcagcctagtcatgcctcccaactgtggtggtatatgtgtacacacatacacagggtggatggagaagaggttgctgattaaaatacactccccctataaaggggaagggggagtgtgacactttctttccatgttcaagtgaaaataaataatgtaccctgca

SEQ ID NO: 369766 - DNA, 1699 bp, Homo sapiens
ccaccaagcccagctaattttttctttttttgtagaaacgggtctccctatgttgcccaggctggtcttaaacgcctgggctcaagtgatcctcctgccttggcctcccaaaatgctgggattacaggtgtgagcccctgtgcctggccagtgtttatttttaaacaaacacttcaaaaatttaataaacatgtataaagcactatactgtgccaggcattgttagcaactgggaatatgggaatgcatgagactagttcctgcccttgagtgtctcatcggttctttccctgccctttcagtacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctgcctttttttttttttttttaaagaaaaagacaaaagaaagtggaagtggtattccccacccctccctgcacccatgtgcctgggcttcccctttatttcccttttccatttaccccgtaatgtgtctctacagctaccttaccactgagccgtaagacaaatgtataggaagaagcaaagtctacagcacatagtctttgtaagggattgatgtgaacacttttttttggatgcactaaggagttatcaatacttctggctttatgagagctcttaaattttgtctaaaaaaccaaagggctgtgagtaagggagctatgtggaaagtgggactctgaagtgtattttgaaaattaatcgccaccctcttccaaattatagaattttttaaaaacaagctgtggccctttccactctctcctggcctctggtgctgctcctctctgccgcctttcctccattccatggcttgaaacctctgcctgatgtggctccttcctttttcccatttgtcaaaccctcttcaaaggaggaacagataagactgggtcagcctagtcatgcctcccaactgtggtggtatatgtgtacacacatacacagggtggatggagaagaggttgctgattaaaatacactccccctataaaggggaagggggagtgtgacactttctttccatgttcaagtgaaaataaataatgtaccctgca

SEQ ID NO: 369767 - DNA, 1603 bp, Homo sapiens
tccggctcatgtctcactatggcctcgaagccgccactaaccggccgggttccgggaggcgccgttcaggatgcagccacccccgcccgcctgtcccctcccccacggccgcggcggcggcggcggcggcggctgctggagcccggatgcggcgccgtgaggcaggcccgggagagcggcgcggatggatccaacatggcggcgccgagcctgagccgagagaagagacctgggaaattaagtttcttgcggagtacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctgcctttcttatgatattcttattttaaaaggaaaaacagacaaagagacacggtggaaggtggatatttccccaaacccatcaccgtgacaccacatgtgtgtgccgggagacttccccattagatatgccacttaatcacattattacccgcgagaagagggtggtccctccctagcggagacgatacccgtgtcccacgaacgtgggagcgccgggtagatgaaaacaccacgtgtggatctatgcgggaaacgcaacagcacacaagagttcttaccacgggccaacgagttagggctccgttgtgggcttagcggggaattctggacgtgcgtgcaccaccacctctcttacagagtggggaagtggcaccaacaggagggaacgacataagactcagagacgacaaaaccgatgctcggtggaggaccgtctagcagacgacaagaaaaggacacccataaggaaacactcgacgcgggcccgataacaacacaagaccccccccagaggggggcccgtgcaagagaagacatacacggaggggacagaccccatatcgagggcagcaacaacacaggcgtgggggcgacgcctgcccgaaacaacgagaggagaatactccacgggggcacaacaacacttagtaaccacagccggagaa

SEQ ID NO: 369768 - DNA, 1832 bp, Homo sapiens
tgggcgatccgctcgtattgaagggggaagagacctgggaaattaagtttcttgcggagtacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagtgcctccccactatcctgtggtgtgttgccccacttcgggtcctcagatgtgtagcaagcggccagcccgagggagagccacacttgggagccagcgaaaacgccggaagtcagtgacaccagatcccaaggagaagcagacatgtgacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctccctgcacccatgtgcctgggcttcccctttatttcccttttccatttaccccgtaatgtgtctctacagctaccttaccactgagccgtaagacaaatgtataggaagaagcaaagtctacagcacatagtctttgtaagggattgatgtgaacacttttttttggatgcactaaggagttatcaatacttctggctttatgagagctcttaaattttgtctaaaaaaccaaagggctgtgagtaagggagctatgtggaaagtgggactctgaagtgtattttgaaaattaatcgccaccctcttccaaattatagaattttttaaaaacaagctgtggccctttccactctctcctggcctctggtgctgctcctctctgccgcctttcctccattccatggcttgaaacctctgcctgatgtggctccttcctttttcccatttgtcaaaccctcttcaaaggaggaacagataagactgggtcagcctagtcatgcctcccaactgtggtggtatatgtgtacacacatacacagggtggatggagaagaggttgctgattaaaatacactccccctataaaggggaagggggagtgtgacactttctttccatgttcaagtgaaaataaataatgtaccctgca

SEQ ID NO: 369769 - DNA, 2091 bp, Homo sapiens
tccggctcatgtctcactatggcctcgaagccgccactaaccggccgggttccgggaggcgccgttcaggatgcagccacccccgcccgcctgtcccctcccccacggccgcggcggcggcggcggcggcggctgctggagcccggatgcggcgccgtgaggcaggcccgggagagcggcgcggatggatccaacatggcggcgccgagcctgagccgagagaagagacctgggaaattaagtttcttgcggagtacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagtgcctccccactatcctgtggtgtgttgccccacttcgggtcctcagatgtgtagcaagcggccagcccgagggagagccacacttgggagccagcgaaaacgccggaagtcagtgacaccagatcccaaggagaagcagacatgtgacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctgcctttttttttttttttttaaagaaaaagacaaaagaaagtggaagtggtattccccacccctccctgcacccatgtgcctgggcttcccctttatttcccttttccatttaccccgtaatgtgtctctacagctaccttaccactgagccgtaagacaaatgtataggaagaagcaaagtctacagcacatagtctttgtaagggattgatgtgaacacttttttttggatgcactaaggagttatcaatacttctggctttatgagagctcttaaattttgtctaaaaaaccaaagggctgtgagtaagggagctatgtggaaagtgggactctgaagtgtattttgaaaattaatcgccaccctcttccaaattatagaattttttaaaaacaagctgtggccctttccactctctcctggcctctggtgctgctcctctctgccgcctttcctccattccatggcttgaaacctctgcctgatgtggctccttcctttttcccatttgtcaaaccctcttcaaaggaggaacagataagactgggtcagcctagtcatgcctcccaactgtggtggtatatgtgtacacacatacacagggtggatggagaagaggttgctgattaaaatacactccccctataaaggggaagggggagtgtgacactttctttccatgttcaagtgaaaataaataatgtaccctgca

SEQ ID NO: 369770 - DNA, 2027 bp, Homo sapiens
tccggctcatgtctcactatggcctcgaagccgccactaaccggccgggttccgggaggcgccgttcaggatgcagccacccccgcccgcctgtcccctcccccacggccgcggcggcggcggcggcggcggctgctggagcccggatgcggcgccgtgaggcaggcccgggagagcggcgcggatggatccaacatggcggcgccgagcctgagccgagagaagagacctgggaaattaagtttcttgcggagtacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagtgcctccccactatcctgtggtgtgttgccccacttcgggtcctcagatgtgtagcaagcggccagcccgagggagagccacacttgggagccagcgaaaacgccggaagtcagtgacaccagatcccaaggagaagcagacatgtgacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctccctgcacccatgtgcctgggcttcccctttatttcccttttccatttaccccgtaatgtgtctctacagctaccttaccactgagccgtaagacaaatgtataggaagaagcaaagtctacagcacatagtctttgtaagggattgatgtgaacacttttttttggatgcactaaggagttatcaatacttctggctttatgagagctcttaaattttgtctaaaaaaccaaagggctgtgagtaagggagctatgtggaaagtgggactctgaagtgtattttgaaaattaatcgccaccctcttccaaattatagaattttttaaaaacaagctgtggccctttccactctctcctggcctctggtgctgctcctctctgccgcctttcctccattccatggcttgaaacctctgcctgatgtggctccttcctttttcccatttgtcaaaccctcttcaaaggaggaacagataagactgggtcagcctagtcatgcctcccaactgtggtggtatatgtgtacacacatacacagggtggatggagaagaggttgctgattaaaatacactccccctataaaggggaagggggagtgtgacactttctttccatgttcaagtgaaaataaataatgtaccctgca

SEQ ID NO: 369771 - DNA, 1901 bp, Homo sapiens
tatttcaatcatgggctggtgtctttcattgatagttactgtgccctttgccttacaattgacatacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagtgcctccccactatcctgtggtgtgttgccccacttcgggtcctcagatgtgtagcaagcggccagcccgagggagagccacacttgggagccagcgaaaacgccggaagtcagtgacaccagatcccaaggagaagcagacatgtgacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctgcctttttttttttttttttaaagaaaaagacaaaagaaagtggaagtggtattccccacccctccctgcacccatgtgcctgggcttcccctttatttcccttttccatttaccccgtaatgtgtctctacagctaccttaccactgagccgtaagacaaatgtataggaagaagcaaagtctacagcacatagtctttgtaagggattgatgtgaacacttttttttggatgcactaaggagttatcaatacttctggctttatgagagctcttaaattttgtctaaaaaaccaaagggctgtgagtaagggagctatgtggaaagtgggactctgaagtgtattttgaaaattaatcgccaccctcttccaaattatagaattttttaaaaacaagctgtggccctttccactctctcctggcctctggtgctgctcctctctgccgcctttcctccattccatggcttgaaacctctgcctgatgtggctccttcctttttcccatttgtcaaaccctcttcaaaggaggaacagataagactgggtcagcctagtcatgcctcccaactgtggtggtatatgtgtacacacatacacagggtggatggagaagaggttgctgattaaaatacactccccctataaaggggaagggggagtgtgacactttctttccatgttcaagtgaaaataaataatgtaccctgca

SEQ ID NO: 369772 - DNA, 2139 bp, Homo sapiens
ccaccaagcccagctaattttttctttttttgtagaaacgggtctccctatgttgcccaggctggtcttaaacgcctgggctcaagtgatcctcctgccttggcctcccaaaatgctgggattacaggtgtgagcccctgtgcctggccagtgtttatttttaaacaaacacttcaaaaatttaataaacatgtataaagcactatactgtgccaggcattgttagcaactgggaatatgggaatgcatgagactagttcctgcccttgagtgtctcatcggttctttccctgccctttcagtacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagtgcctccccactatcctgtggtgtgttgccccacttcgggtcctcagatgtgtagcaagcggccagcccgagggagagccacacttgggagccagcgaaaacgccggaagtcagtgacaccagatcccaaggagaagcagacatgtgacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctgcctttttttttttttttttaaagaaaaagacaaaagaaagtggaagtggtattccccacccctccctgcacccatgtgcctgggcttcccctttatttcccttttccatttaccccgtaatgtgtctctacagctaccttaccactgagccgtaagacaaatgtataggaagaagcaaagtctacagcacatagtctttgtaagggattgatgtgaacacttttttttggatgcactaaggagttatcaatacttctggctttatgagagctcttaaattttgtctaaaaaaccaaagggctgtgagtaagggagctatgtggaaagtgggactctgaagtgtattttgaaaattaatcgccaccctcttccaaattatagaattttttaaaaacaagctgtggccctttccactctctcctggcctctggtgctgctcctctctgccgcctttcctccattccatggcttgaaacctctgcctgatgtggctccttcctttttcccatttgtcaaaccctcttcaaaggaggaacagataagactgggtcagcctagtcatgcctcccaactgtggtggtatatgtgtacacacatacacagggtggatggagaagaggttgctgattaaaatacactccccctataaaggggaagggggagtgtgacactttctttccatgttcaagtgaaaataaataatgtaccctgca

SEQ ID NO: 369773 - DNA, 2181 bp, Homo sapiens
tccggctcatgtctcactatggcctcgaagccgccactaaccggccgggttccgggaggcgccgttcaggatgcagccacccccgcccgcctgtcccctcccccacggccgcggcggcggcggcggcggcggctgctggagcccggatgcggcgccgtgaggcaggcccgggagagcggcgcggatggatccaacatggcggcgccgagcctgagccgagagaagagacctgggaaattaagtttcttgcggagtacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagtgcctccccactatcctgtggtgtgttgccccacttcgggtcctcagatgtgtagcaagcggccagcccgagggagagccacacttgggagccagcgaaaacgccggaagtcagtgacaccagatcccaaggagaagcagacatgtggtgaggaagttcaagggttccagagatggagcagacttgaaggagaatataaagaactgctgggacactgggcagtttatgctattcagtacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctgcctttttttttttttttttaaagaaaaagacaaaagaaagtggaagtggtattccccacccctccctgcacccatgtgcctgggcttcccctttatttcccttttccatttaccccgtaatgtgtctctacagctaccttaccactgagccgtaagacaaatgtataggaagaagcaaagtctacagcacatagtctttgtaagggattgatgtgaacacttttttttggatgcactaaggagttatcaatacttctggctttatgagagctcttaaattttgtctaaaaaaccaaagggctgtgagtaagggagctatgtggaaagtgggactctgaagtgtattttgaaaattaatcgccaccctcttccaaattatagaattttttaaaaacaagctgtggccctttccactctctcctggcctctggtgctgctcctctctgccgcctttcctccattccatggcttgaaacctctgcctgatgtggctccttcctttttcccatttgtcaaaccctcttcaaaggaggaacagataagactgggtcagcctagtcatgcctcccaactgtggtggtatatgtgtacacacatacacagggtggatggagaagaggttgctgattaaaatacactccccctataaaggggaagggggagtgtgacactttctttccatgttcaagtgaaaataaataatgtaccctgca

SEQ ID NO: 369774 - DNA, 2044 bp, Homo sapiens
tccggctcatgtctcactatggcctcgaagccgccactaaccggccgggttccgggaggcgccgttcaggatgcagccacccccgcccgcctgtcccctcccccacggccgcggcggcggcggcggcggcggctgctggagcccggatgcggcgccgtgaggcaggcccgggagagcggcgcggatggatccaacatggcggcgccgagcctgagccgagagaagagacctgggaaattaagtttcttgcggagtacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagatgtgtagcaagcggccagcccgagggagagccacacttgggagccagcgaaaacgccggaagtcagtgacaccagatcccaaggagaagcagacatgtgacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctgcctttttttttttttttttaaagaaaaagacaaaagaaagtggaagtggtattccccacccctccctgcacccatgtgcctgggcttcccctttatttcccttttccatttaccccgtaatgtgtctctacagctaccttaccactgagccgtaagacaaatgtataggaagaagcaaagtctacagcacatagtctttgtaagggattgatgtgaacacttttttttggatgcactaaggagttatcaatacttctggctttatgagagctcttaaattttgtctaaaaaaccaaagggctgtgagtaagggagctatgtggaaagtgggactctgaagtgtattttgaaaattaatcgccaccctcttccaaattatagaattttttaaaaacaagctgtggccctttccactctctcctggcctctggtgctgctcctctctgccgcctttcctccattccatggcttgaaacctctgcctgatgtggctccttcctttttcccatttgtcaaaccctcttcaaaggaggaacagataagactgggtcagcctagtcatgcctcccaactgtggtggtatatgtgtacacacatacacagggtggatggagaagaggttgctgattaaaatacactccccctataaaggggaagggggagtgtgacactttctttccatgttcaagtgaaaataaataatgtaccctgca

SEQ ID NO: 369775 - DNA, 1017 bp, Homo sapiens
tccggctcatgtctcactatggcctcgaagccgccactaaccggccgggttccgggaggcgccgttcaggatgcagccacccccgcccgcctgtcccctcccccacggccgcggcggcggcggcggcggcggctgctggagcccggatgcggcgccgtgaggcaggcccgggagagcggcgcggatggatccaacatggcggcgccgagcctgagccgagagaagagacctgggaaattaagtttcttgcggagtacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagtgcctccccactatcctgtggtgtgttgccccacttcgggtcctcagatgtgtagcaagcggccagcccgagggagagccacacttgggagccagcgaaaacgccggaagtcagtgacaccagatcccaaggagaagcagacatgtggtgaggaagttcaagggttccagagatggagcagacttgaaggagaatataaagaactgctgggacactgggcagtttatgctattcagtgggcatcctatagtagtcgtcctcaggca

SEQ ID NO: 369776 - DNA, 432 bp, Homo sapiens
ccttccttgttggactccagtcggaaccaatcgttgtcagcattcttgttgttctccacataccggataagggactgatattcctccttcagtcgctgcacccacaactcacgatctcggggtccggcgttagtcttcagcaccgggatctcagacacaacacgtcgcgtggcttcatccgccatcttggaccagggcgcaagagaaacgcggaagtggtgttgcctgtagcttacctcaaggcgccgtcatctttactatgggaagatgagacgttgggttgctgacactggtcctcctacgcctgagaccgacgttgccaggaccgcagggtcagggggacttggctgtcccccgtctttcaaataaagctgtttgtctaaaataaataaataaataaataaataaataaataaataaataaatttattt

SEQ ID NO: 369777 - DNA, 271 bp, Homo sapiens
aacctttaaaaaaaaaaaagaattgaaaaaagcctgacttttgagcctattgtcctcctaataaattctattttgtttatcagaagctgattataatctctgttctacttatgcaatctttctttcttttttttttttttttgagacggagtctcgctctgtcacccaggctggagtgcagtggcgctgtcttggctcactgcaagctccacctcttgggttcacaccatcctgcctcagcctcccaagtagctgggactacaggcgcccg

SEQ ID NO: 369778 - DNA, 2277 bp, Homo sapiens
gggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaaagcagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcaga

SEQ ID NO: 369779 - DNA, 1646 bp, Homo sapiens
  misc_feature (90)..(90): n is a, c, g, or t
atccaatgagttgttaaaaattactttaatgcaaagaactacgtattttaacttattggagatcaggtttcctttttcagaacagtgatnaaaaggtcacttttgagatatcccatgaaactctgactgattaacatgatatattcccttgtaaatttaggactgatatttttaaacataaaattgccaacttaaaaaaataacaaccttgttttacaaacaagagtttttcctggagagctgtgtgtgaatttagatatataataagaactgtctttaaaggaaacctgtgattaatatttttattgatatatgaaataaatagctattatatatttgttttatttatttgggtcctaatttacaacattaccttaaagctagacaaacctgttatagctatggcaaagacacaatattctggaaacctatgtaggtatttcattgttacctattttagaagtctttccttagaatttgaaaattttattttactaaagtgaatgtgatggtaaatttaaatcctccccaaacaatgtaacattaggattgaattaagtatatttgttcttttataaaattaattaattggctaagcacaacttggcctttaggtttgcttgtgggaaatgtactccaaggttctgcaggtttttgttttgttttttgttttgttttgtttcatttgcaaactgttctttgcatacttatgtttgtggtccttgtaactgacttctgctttttgtttgtttccttttctttcctttatctgttttacttcccccatactgtgttgttgctaccagtttctattgctccaccccctccccctatgcctcagttgactccacagatacctctcacaggcttcgtggccagggtgcaggaaaacagtaagtttggaaaaactgagctatggaagagtagaggctgtctccttatagcatgcatggctgacgatgagtcatcgttttccttacttttattgagaagctaatcttgaaaataggtgcagacatgttactgaaactgaagagcacggtcttcagttttttctctttgtgtgcatggttactgacccatataaatttcaaagctgcaattttcttatgtctttacatgatcctaaaacaggagatctgatctttacatattcttaaggaaagaataatcaaacacaaaaattcaaattatatggaaacttttagcttctaacagttactagaattagaagacatttttaattctaataaatttatcaagagataggtagatatactgtaagattaaatttaatatgaaattggggcagattttccccccttaatttcaaaattttagggaaagctttgtagcctcagatttttgtacatacatgatattgaacctacgtaaaggttcattgttaggataagattgaatgaccaggaataagtaaattacattcatgctatccatttcagtgtgagtgataagcaatttagcatccttttcacattttggctacatccaggcccacgaagattgttcctgaatatgaaaatcagttaacttttttagatcttctctcgaatgaagttcagggatttttttttgtggggggggagaagttattttggatatatggctttaatcaggatagacta

SEQ ID NO: 369780 - DNA, 905 bp, Homo sapiens
cggacgcgtgggtcgacccacgcgtccgagaaggtagctagctgatcactaatgatactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaaaataaaacacaaaaaaacaaaacacaaacaaacataacacacacaagggggggagccaccaaaaaaataacacgaaaaggggccccaaattacacgaaacaccgagtacagggaaacagaggggcaacaatagagagaagccatataaaaaacgagagaccttgcgctcgtctattataacaaagcgagcagcaacaggcatacaaacacggtactaacctgtacgaactttgtggaaaacgacacacctatacccatcgaggagagggacccatacgcggacgcaatattccctcgagagaatcttcgagcgctctgcaggcacctttttacacttcctacagcggcttccgcgggggtacccagcgcgcactacatacgctcgcggaacaagactttgtggcacacggctagtcgtttagagcagttatcgcgcaacgcggatgctaatc

SEQ ID NO: 369781 - DNA, 652 bp, Homo sapiens
  misc_feature (626)..(626): n is a, c, g, or t
caaaccattaacgtaatgttactcatatcattactgcagtccaaatgacaaaagtgacatagatttattttagattgttaacatttgtcccgatctgaaccttggaataaggaaactactcctataatccttataaaaagagacattgtctcctaacaccctgcattcattaatttgtagtacttccagatacccttatttttagctcattttgttatttttaaatgattcttgagtagcataaactttaacacaccaagcttttatttctaatcattgcatgttttattatagtgcatgctgtacttaagttagagctttcttaaattctgttaacttataagtttccatctagacttatttttgattcaaatcaatcatatgaatctttttagttgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagtgttgcaattatgatattcaatgatgaggctggttgaagagttgnatcaatgattgcttgtcctggaacat

SEQ ID NO: 369782 - DNA, 854 bp, Homo sapiens
  misc_feature (90)..(90): n is a, c, g, or t
atccaatgagttgttaaaaattactttaatgcaaagaactacgtattttaacttattggagatcaggtttcctttttcagaacagtgatnaaaaggtcacttttgagatatcccatgaaactctgactgattaacatgatatattcccttgtaaatttaggactgatatttttaaacataaaattgccaacttaaaaaaataacaaccttgttttacaaacaagagtttttcctggagagctgtgtgtgaatttagatatataataagaactgtctttaaaggaaacctgtgattaatatttttattgatatatgaaataaatagctattatatatttgttttatttatttgggtcctaatttacaacattaccttaaagctagacaaacctgttatagctatggcaaagacacaatattctggaaacctatgtaggtatttcattgttacctattttagaagtctttccttagaatttgaaaattttattttactaaagtgaatgtgatggtaaatttaaatcctccccaaacaatgtaacattaggattgaattaagtatatttgttcttttataaaattaattaattggctaagcacaacttggcctttaggtttgcttgtgggaaatgtactccaaggttctgcaggtttttgttttgttttttgttttgttttgtttcatttgcaaactgttctttgcatacttatgtttgtggtccttgtaactgacttctgctttttgtttgtttccttttctttcctttatctgttttacttcccccatactgtgttgttgctaccagtttctattgctccaccccctctaccccctctagagccaaaaaaaaaaa

SEQ ID NO: 369783 - DNA, 3945 bp, Homo sapiens
gggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaaagcagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaaaataaaacacaaaaaaacaaaacacaaacaaacataacacacacaagggggggagccaccaaaaaaataacacgaaaaggggccccaaattacacgaaacaccgagtacagggaaacagaggggcaacaatagagagaagccatataaaaaacgagagaccttgcgctcgtctattataacaaagcgagcagcaacaggcatacaaacacggtactaacctgtacgaactttgtggaaaacgacacacctatacccatcgaggagagggacccatacgcggacgcaatattccctcgagagaatcttcgagcgctctgcaggcacctttttacacttcctacagcggcttccgcgggggtacccagcgcgcactacatacgctcgcggaacaagactttgtggcacacggctagtcgtttagagcagttatcgcgcaacgcggatgctaatc

SEQ ID NO: 369784 - DNA, 3194 bp, Homo sapiens
gggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaaagcagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatg

SEQ ID NO: 369785 - DNA, 2396 bp, Homo sapiens
aggttccgtcgtctttcaactgcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagaaaacatttctgtccctcctccttctggagctccaccagcaccacctctggcaccacttctcccagtgagcactgtgatagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaatttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaaagcagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcaga

SEQ ID NO: 369786 - DNA, 2364 bp, Homo sapiens
gggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaatttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaaagcagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcaga

SEQ ID NO: 369787 - DNA, 2298 bp, Homo sapiens
gggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacacagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaatttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaaagcagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcaga

SEQ ID NO: 369788 - DNA, 2100 bp, Homo sapiens
gggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagttgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaaagcagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcaga

SEQ ID NO: 369789 - DNA, 2176 bp, Homo sapiens
gggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaaagcagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcaga

SEQ ID NO: 369790 - DNA, 3979 bp, Homo sapiens
gggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaatttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaatatttacctggaggactcgtacttaggtgtcttaacgtgaattgagtctccaaggtctccatgtgaaacaaagcagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaaaataaaacacaaaaaaacaaaacacaaacaaacataacacacacaagggggggagccaccaaaaaaataacacgaaaaggggccccaaattacacgaaacaccgagtacagggaaacagaggggcaacaatagagagaagccatataaaaaacgagagaccttgcgctcgtctattataacaaagcgagcagcaacaggcatacaaacacggtactaacctgtacgaactttgtggaaaacgacacacctatacccatcgaggagagggacccatacgcggacgcaatattccctcgagagaatcttcgagcgctctgcaggcacctttttacacttcctacagcggcttccgcgggggtacccagcgcgcactacatacgctcgcggaacaagactttgtggcacacggctagtcgtttagagcagttatcgcgcaacgcggatgctaatc

SEQ ID NO: 369791 - DNA, 1519 bp, Homo sapiens
caaaccattaacgtaatgttactcatatcattactgcagtccaaatgacaaaagtgacatagatttattttagattgttaacatttgtcccgatctgaaccttggaataaggaaactactcctataatccttataaaaagagacattgtctcctaacaccctgcattcattaatttgtagtacttccagatacccttatttttagctcattttgttatttttaaatgattcttgagtagcataaactttaacacaccaagcttttatttctaatcattgcatgttttattatagtgcatgctgtacttaagttagagctttcttaaattctgttaacttataagtttccatctagacttatttttgattcaaatcaatcatatgaatctttttagttgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaaagcagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcaga

SEQ ID NO: 369792 - DNA, 1993 bp, Homo sapiens
gggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaatttctattgctccaccccctccccctatgcctcagttgactccacagatacctctcacaggcttcgtggccagggtgcaggaaaacagtaagtttggaaaaactgagctatggaagagtagaggctgtctccttatagcatgcatggctgacgatgagtcatcgttttccttacttttattgagaagctaatcttgaaaataggtgcagacatgttactgaaactgaagagcacggtcttcagttttttctctttgtgtgcatggttactgacccatataaatttcaaagctgcaattttcttatgtctttacatgatcctaaaacaggagatctgatctttacatattcttaaggaaagaataatcaaacacaaaaattcaaattatatggaaacttttagcttctaacagttactagaattagaagacatttttaattctaataaatttatcaagagataggtagatatactgtaagattaaatttaatatgaaattggggcagattttccccccttaatttcaaaattttagggaaagctttgtagcctcagatttttgtacatacatgatattgaacctacgtaaaggttcattgttaggataagattgaatgaccaggaataagtaaattacattcatgctatccatttcagtgtgagtgataagcaatttagcatccttttcacattttggctacatccaggcccacgaagattgttcctgaatatgaaaatcagttaacttttttagatcttctctcgaatgaagttcagggatttttttttgtggggggggagaagttattttggatatatggctttaatcaggatagacta

SEQ ID NO: 369793 - DNA, 1066 bp, Homo sapiens
gggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtagcattttatattacattaacaagctaatttgcatatccagtaaatattttggataggaaatattgtcataaagatgattttaatagattctctttagcagctggcattataattttcatacaatatttaatatgaattttactaaggttggggtgcaattttatcagttgaataggctgtattaaaaagatattaaaattagaaatggttattaagccataaatcctagacaaatattacccatttgtgttgtgaattctatgtctttctttcactactgaacatttaaaaataaaagtctacatgcttttcaaaattactttagaaaataatttataaatacttttatcgtttcatttctaaatatgtatatatatttgtatacctgtgtgtgtatctataatgccagcaacttattaaaaaatgaaaattgta

SEQ ID NO: 369794 - DNA, 660 bp, Homo sapiens
aggtataaactcggtagcctctttatgtacaaaattcatactcatttgagcatgctttacatgggggtatcttttttctttttcttcccgatacattgtactttcttgctgtttcaaaatgttgagttttcttttcttgtactctgacctgaattataaactattttattagaaaacatttctgtccctcctccttctggagctccaccagcaccacctctggcaccacttctcccagtgagcactgtgataggtgagattgcatagccattggagccattgaactcactttacataattcataataaactcctctgtgctagtagagtgctggcttttatagttattaggttgcaggtgataatacaaagtttaaagtattaaatctaatatcactaacttctggtgaaaggcttctgcacttatacagtaaacaaatataaaacaactttttctataatatgaaatgcttggtttataaccaacttaatgtgtttttaatttgttgtttgtttagatttttctagtctaatcccccctgccccgcacaagtgaaacttaatttggaactctctggtatatacaacagtcaaaggatcagggtgaaggtggggacaggaggagaaaaattgaaaggcaaacgatatgtgtgggatgggg

SEQ ID NO: 369795 - DNA, 2445 bp, Homo sapiens
gggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagaaaacatttctgtccctcctccttctggagctccaccagcaccacctctggcaccacttctcccagtgagcactgtgatagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaatttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaaagcagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcaga

SEQ ID NO: 369796 - DNA, 3281 bp, Homo sapiens
gggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaatttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaaagcagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatg

SEQ ID NO: 369797 - DNA, 3011 bp, Homo sapiens
gggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaaagcagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctacca

SEQ ID NO: 369798 - DNA, 2187 bp, Homo sapiens
gggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagtttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaaagcagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcaga

SEQ ID NO: 369799 - DNA, 2363 bp, Homo sapiens
gggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaatttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaaagcagcaaaaagagaattatctgtaatgttgtaatttgtacctaagttttttaatgagtgaaatttgcattataaactttttccattcataaatacataagtgaaccaaaggttgtccatcctaccctaaaaagattttaatgtgagcttaagatgtaaataaataattttgc

SEQ ID NO: 369800 - DNA, 1298 bp, Homo sapiens
aggttccgtcgtctttcaactgcggtttgtatccgggctgtgaggtgctcggagcctcggcggaccttgctgcctctgtctctttaacgcgagaggaagcgatgcagaggggtggaaaatggcagagtccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaaagcagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcaga

SEQ ID NO: 369801 - DNA, 1894 bp, Homo sapiens
gggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaagtaagcttgtgctttgcaggcatacagcaacagtggagctccttttgaaggaaattatttgaaactgttattcttgccagtgatagacaacaattgaaaaccatgatgtttcatgtttatttttgttttaggatattagtccttgaatcataccattttaagagtaattgtttaccactttctcttccaaaatttagacttaccaagtatacttaactaaatttatcgagacgtgtctatattgagtataccaaaatttaactttaatatgcgattttattacataagtagaactagagaacaaaaacattgcagaaataaactgaatttattggcatgtttgagacagcgtagtaatggtaaaattaaagacacaaacattgtcaaagttttccttcaaattaatataatgaaattgctggctatcacttttaaggtcattaacgtgttcagaaatgagttcaaaaccgattaaaactgtttgtgatgcctgcttaattactctgtctttgaataattctaatggtgggaatttcttttgatttctttctgtttacctcaaattgcacatctcaacactaattgcagtcagtgtttaaaagctggtaagaaaagaaaatagttttagcatataatgttaggaagttagaatagtgtagggtagtcattaatatcactttccatattaagatgttcaatgcaaaaaggaaaaaaaacaaaattagaaatgaacctgttgtc

SEQ ID NO: 369802 - DNA, 916 bp, Homo sapiens
gggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtaagcatggaaataaccagcctgcaagaactggcacactgtcgagaacaaatcctcctactcagaaaccgccaagtcctcccatgtcaggccggggaacactgggaggatactcttataaaacctggaacctggaaaccccaaagtctagtgttatatgacaggctgtagggtggacgtagtatccaggggcagctcttatcgagcagccctggctccggggcgggattgaacagggcagttggtccttggggtacctcgccccatggtggggtacccggcccagtg

SEQ ID NO: 369803 - DNA, 293 bp, Homo sapiens
cgacagcagtgaaagacaccatagaatggacaaccataggggaaagtttggggatgaaggagagcttaaaggtgtttcaattaagttagaaaactgacacaggctgttgagaattctttgccacttttcccaccccaaaacagcatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgtt

SEQ ID NO: 369804 - DNA, 646 bp, Homo sapiens
ttagaaggtatattaagctcagaaactttgtaattttgacttggcctggtgataatttccaggccttttccctgtaatcagttgcagaagtaaaaactctcttcctccccagttcatctgcatctcgttactgggccacaagaaatagcagtccacccctcagtctggtctgcaaatacacatacagatcatgtgcacacatagtgtgtacattcctagaaatggtactgtcacatatggagtgatttgctacgtccttcacttgaggatagttctagtagagtgagtgcagagctgatgacaagttgaaatgagatcaatctatttgtttaaaaatatacaaatattttgcatttaatttcatcggttaaaatgtctaaacattagagtaaacccatttccctatctacatccttactctgaagtccactaatcaaacctactcttccacagctgttctctggtccaccaagggctatgaggctcaccccttggatggtgctcagaaccacaaggaatactgaagaagccttgcctatgatttcaggtggcatcagacattgggctaattttcaaggtgtctctccttcccaacaggacagtcggagtctggttctttaataaatagctatatggatcttactta

SEQ ID NO: 369805 - DNA, 569 bp, Homo sapiens
gcggccgcctactactactactgctcgaattcaagcttctaacgatgtacggggacatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgttggcctgtcttttttgaagcatgtgtgttatgtgtagttagatatatttcacttatgtgagtcatcatggtgttggtcttgtagcccattatttttcctgtgcttccccagcttcccaaagtagctagttagaacttaaggtaaatatttattcttgggttggtggagtggatattgccagttaggagtcatggatcaattactgattatattgaaagtaaatataatcaattatgtacttttgagctttgcaggttcaatttaggtaaaaatcacattatgaaactgggaaagtctgaaggaatatgggcaaaatatttctcagtaaagcttccatgcttcacccttgacatgattacccttga

SEQ ID NO: 369806 - DNA, 2117 bp, Homo sapiens
agcggaagtagagttgcggttccctcgggagaggggcggaggctcagaggtgcaccacgtggggtttgctgccggagcggagtctccggccggcgtccagtttgagtctaggttggagttggaaccgtggagatgcggaaggaaaccccaccccccctagtgcccccggcggcccgggagtggaatcttcccccaaatgcgcccgcctgcatggaacggcagttggaggctgcgcggtaccggtccgatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctgcatcaaggtttgggaccttgctcagcaggtggtactgagttcataccgagctcatgctgctcaggtcacttgtgttgctgcctctcctcacaaggactctgtgtttctttcatgcagcgaggacaatagaattttactctgggatacccgctgtcccaagccagcatcacagattggctgcagtgcgcctggctaccttcctacctcgctggcttggcatcctcagcaaagtgaagtctttgtctttggtgatgagaatgggacagtctcccttgtggacaccaagagtacaagctgtgtcctgagctcagctgtacactcccagtgtgtcactgggctggtgttctccccacacagtgttcccttcctggcctctctcagtgaagactgctcacttgctgtgctggactcaagcctttctgagttgtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccctagtgatgggacatatatgagagagaagtgtttttctatcatagacaccataggggaaagtttggggatgaaggagagcttaaaggtgtttcaattaagttagaaaactgacacaggctgttgagaattctttgccacttttcccaccccaaaacagcatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgtt

SEQ ID NO: 369807 - DNA, 2047 bp, Homo sapiens
agcggaagtagagttgcggttccctcgggagaggggcggaggctcagaggtgcaccacgtggggtttgctgccggagcggagtctccggccggcgtccagtttgagtctaggttggagttggaaccgtggagatgcggaaggaaaccccaccccccctagtgcccccggcggcccgggagtggaatcttcccccaaatgcgcccgcctgcatggaacggcagttggaggctgcgcggtaccggtccgatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctgcatcaaggtttgggaccttgctcagcaggtggtactgagttcataccgagctcatgctgctcaggtcacttgtgttgctgcctctcctcacaaggactctgtgtttctttcatgcagcgaggacaatagaattttactctgggatacccgctgtcccaagccagcatcacagattggctgcagtgcgcctggctaccttcctacctcgctggcttggcatcctcagcaaagtgaagtctttgtctttggtgatgagaatgggacagtctcccttgtggacaccaagagtacaagctgtgtcctgagctcagctgtacactcccagtgtgtcactgggctggtgttctccccacacagtgttcccttcctggcctctctcagtgaagactgctcacttgctgtgctggactcaagcctttctgagttgtttagaagccaagcccacagagactttgtgagagatgcgacttggtccccgctcaatcaccccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccctagtgatgggacatatatgagagagaagtgtttttctatcatagacaccataggggaaagtttggggatgaaggagagcttaaaggtgtttcaattaagttagaaaactgacacaggctgttgagaattctttgccacttttcccaccccaaaacagcatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgtt

SEQ ID NO: 369808 - DNA, 2332 bp, Homo sapiens
agcggaagtagagttgcggttccctcgggagaggggcggaggctcagaggtgcaccacgtggggtttgctgccggagcggagtctccggccggcgtccagtttgagtctaggttggagttggaaccgtggagatgcggaaggaaaccccaccccccctagtgcccccggcggcccgggagtggaatcttcccccaaatgcgcccgcctgcatggaacggcagttggaggctgcgcggtaccggtccgatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctgcatcaaggtttgggaccttgctcagcaggtggtactgagttcataccgagctcatgctgctcaggtcacttgtgttgctgcctctcctcacaaggactctgtgtttctttcatgcagcgaggacaatagaattttactctgggatacccgctgtcccaagccagcatcacagattggctgcagtgcgcctggctaccttcctacctcgctggcttggcatcctcagcaaagtgaagtctttgtctttggtgatgagaatgggacagtctcccttgtggacaccaagagtacaagctgtgtcctgagctcagctgtacactcccagtgtgtcactgggctggtgttctccccacacagtgttcccttcctggcctctctcagtgaagactgctcacttgctgtgctggactcaagcctttctgagttcatttcttcatctatgaaaatagaagactggattggatgactgatgacatccactgtggatagctacactgctatcctggcgatgaggccatacagttggtgaaatgtgtgtaacacacccaaaaaatgtgccccagatgtgttgggttctctttttttctccaggtctgcttttcttgtctctactctgccccgactttttttctttcttctaggtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccctagtgatgggacatatatgagagagaagtgtttttctatcatagacaccataggggaaagtttggggatgaaggagagcttaaaggtgtttcaattaagttagaaaactgacacaggctgttgagaattctttgccacttttcccaccccaaaacagcatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgtt

SEQ ID NO: 369809 - DNA, 2155 bp, Homo sapiens
agcggaagtagagttgcggttccctcgggagaggggcggaggctcagaggtgcaccacgtggggtttgctgccggagcggagtctccggccggcgtccagtttgagtctaggttggagttggaaccgtggagatgcggaaggaaaccccaccccccctagtgcccccggcggcccgggagtggaatcttcccccaaatgcgcccgcctgcatggaacggcagttggaggctgcgcggtaccggtccgatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctgcatcaaggtttgggaccttgctcagcaggtggtactgagttcataccgagctcatgctgctcaggtcacttgtgttgctgcctctcctcacaaggactctgtgtttctttcatgcagcgaggacaatagaattttactctgggatacccgctgtcccaagccagcatcacagattggctgcagtgcgcctggctaccttcctacctcgctggcttggcatcctcagcaaagtgaagtctttgtctttggtgatgagaatgggacagtctcccttgtggacaccaagagtacaagctgtgtcctgagctcagctgtacactcccagtgtgtcactgggctggtgttctccccacacaggctggacctttcacaaccctctcctccatctgatagtgtgttcccttcctggcctctctcagtgaagactgctcacttgctgtgctggactcaagcctttctgagttgtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccctagtgatgggacatatatgagagagaagtgtttttctatcatagacaccataggggaaagtttggggatgaaggagagcttaaaggtgtttcaattaagttagaaaactgacacaggctgttgagaattctttgccacttttcccaccccaaaacagcatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgtt

SEQ ID NO: 369810 - DNA, 1450 bp, Homo sapiens
agcggaagtagagttgcggttccctcgggagaggggcggaggctcagaggtgcaccacgtggggtttgctgccggagcggagtctccggccggcgtccagtttgagtctaggttggagttggaaccgtggagatgcggaaggaaaccccaccccccctagtgcccccggcggcccgggagtggaatcttcccccaaatgcgcccgcctgcatggaacggcagttggaggctgcgcggtaccggtccgatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctgcatcaaggtttgggaccttgctcagcaggtggtactgagttcataccgagctcatgctgctcaggtcacttgtgttgctgcctctcctcacaaggactctgtgtttctttcatgcagcgaggacaatagaattttactctgggatacccgctgtcccaagccagcatcacagattggctgcagtgcgcctggctaccttcctacctcgctggcttggcatcctcagcaaagtgaagtctttgtctttggtgatgagaatgggacagtctcccttgtggacaccaagagtacaagctgtgtcctgagctcagctgtacactcccagtgtgtcactgggctggtgttctccccacacagtgttcccttcctggcctctctcagtgaagactgctcacttgctgtgctggactcaagcctttctgagttgtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttcccta

SEQ ID NO: 369811 - DNA, 2556 bp, Homo sapiens
agcggaagtagagttgcggttccctcgggagaggggcggaggctcagaggtgcaccacgtggggtttgctgccggagcggagtctccggccggcgtccagtttgagtctaggttggagttggaaccgtggagatgcggaaggaaaccccaccccccctagtgcccccggcggcccgggagtggaatcttcccccaaatgcgcccgcctgcatggaacggcagttggaggctgcgcggtaccggtccgatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctgcatcaaggtttgggaccttgctcagcaggtggtactgagttcataccgagctcatgctgctcaggtcacttgtgttgctgcctctcctcacaaggactctgtgtttctttcatgcagcgaggacaatagaattttactctgggatacccgctgtcccaagccagcatcacagattggctgcagtgcgcctggctaccttcctacctcgctggcttggcatcctcagcaaagtgaagtctttgtctttggtgatgagaatgggacagtctcccttgtggacaccaagagtacaagctgtgtcctgagctcagctgtacactcccagtgtgtcactgggctggtgttctccccacacagtgttcccttcctggcctctctcagtgaagactgctcacttgctgtgctggactcaagcctttctgagttgtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccctagtgatgggacatatatgagagagaagtgtttttctatcatagacaccataggggaaagtttggggatgaaggagagcttaaaggtgtttcaattaagttagaaaactgacacaggctgttgagaattctttgccacttttcccaccccaaaacagcatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgttaaaaaaaaaaaaaaaaaaaaaaaaaaaaggggggcgcgcgcgcccaaaaattccccccgggggcgccccaatttcgcgggtccccggttttcttgtgtcacaagggcgccccatatatgggggaggctcggtatatataagccgatacggcactgcgcccgtcggttatcaacaaccgctcccgcagacttgggggacaacctggcacacgtctgggagactcttgggaaagggacccttaatctccgtggggggcggcgacatatttggggccacacttccctacagagaggatttaaacggcctcaaagggtaactttcaacactcttaacggtgtactacggtgtaaaaccatacggtgcattctgctcgcgtttagacatttcggcacccgggttttagctcttagaccatttttttccgagctgtgtctcaatg

SEQ ID NO: 369812 - DNA, 2578 bp, Homo sapiens
agcggaagtagagttgcggttccctcgggagaggggcggaggctcagaggtgcaccacgtggggtttgctgccggagcggagtctccggccggcgtccagtttgagtctaggttggagttggaaccgtggagatgcggaaggaaaccccaccccccctagtgcccccggcggcccgggagtggaatcttcccccaaatgcgcccgcctgcatggaacggcagttggaggctgcgcggtaccggtccgatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctgcatcaaggtttgggaccttgctcagcaggtggtactgagttcataccgagctcatgctgctcaggtcacttgtgttgctgcctctcctcacaaggactctgtgtttctttcatgcagcgaggacaatagaattttactctgggatacccgctgtcccaagccagcatcacagattggctgcagtgcgcctggctaccttcctacctcgctggcttggcatcctcagcaaagtgaagtctttgtctttggtgatgagaatgggacagtctcccttgtggacaccaagagtacaagctgtgtcctgagctcagctgtacactcccagtgtgtcactgggctggtgttctccccacacagtgttcccttcctggcctctctcagtgaagactgctcacttgctgtgctggactcaagcctttctgagttgtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccctagtgatgggacatatatgagagagaagtgtttttctatcatagacaccataggggaaagtttggggatgaaggagagcttaaaggtgtttcaattaagttagaaaactgacacaggctgttgagaattctttgccacttttcccaccccaaaacagcatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaagagagagagggcggggcgcgagcgcagagacatcctctccccggggcggcggggcgacccaactaactcaccagcccgcaccaccagtatgcgtgttgcagtgaatgtcacgaggaggcgcgcccacctcagagacgtcggaggagacactatatatatatataaatagagcgcgggcggctaggcgcggtagcactaaatacaaccacagagcgggacgggggaggcagacaccagccgtcgcgccagcgggtgccactggcggtagagaaaaacccacatccactcattgtcgtgaggcggataaacactagcgcgcagctccgccccgctcctggt

SEQ ID NO: 369813 - DNA, 2097 bp, Homo sapiens
  misc_feature (155)..(155): n is a, c, g, or t
  misc_feature (171)..(171): n is a, c, g, or t
  misc_feature (176)..(177): n is a, c, g, or t
  misc_feature (193)..(193): n is a, c, g, or t
  misc_feature (203)..(203): n is a, c, g, or t
  misc_feature (205)..(205): n is a, c, g, or t
  misc_feature (215)..(216): n is a, c, g, or t
  misc_feature (221)..(223): n is a, c, g, or t
agcggaagtagagttgcggttccctcgggagaggggcggaggctcagaggtgcaccacgtggggtttgctgccggagcggagtctccggccggcgtccagtttgagtctaggttggagttggaaccgtggagatgcggaaggaaaccccactcgngagaatcgcagaggcngttanntaggaccgtaatagtnagtgcgtgtngncaagctgcgnngtacnnntccgatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctgcatcaaggtttgggaccttgctcagcaggtggtactgagttcataccgagctcatgctgctcaggtcacttgtgttgctgcctctcctcacaaggactctgtgtttctttcatgcagcgaggacaatagaattttactctgggatacccgctgtcccaagccagcatcacagattggctgcagtgcgcctggctaccttcctacctcgctggcttggcatcctcagcaaagtgaagtctttgtctttggtgatgagaatgggacagtctcccttgtggacaccaagagtacaagctgtgtcctgagctcagctgtacactcccagtgtgtcactgggctggtgttctccccacacagtgttcccttcctggcctctctcagtgaagactgctcacttgctgtgctggactcaagcctttctgagttgtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccctagtgatgggacatatatgagagagaagtgtttttctatcatagacaccataggggaaagtttggggatgaaggagagcttaaaggtgtttcaattaagttagaaaactgacacaggctgttgagaattctttgccacttttcccaccccaaaacagcatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgtt

SEQ ID NO: 369814 - DNA, 2094 bp, Homo sapiens
agcggaagtagagttgcggttccctcgggagaggggcggaggctcagaggtgcaccacgtggggtttgctgccggagcggagtctccggccggcgtccagtttgagtctaggttggagttggaaccgtggagatgcggaaggaaaccccacgtggtgtatgctgagtgccgatggaggtaccccagggcgcctgcgttgtgacgggtgaggtgggggccgtccgatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctgcatcaaggtttgggaccttgctcagcaggtggtactgagttcataccgagctcatgctgctcaggtcacttgtgttgctgcctctcctcacaaggactctgtgtttctttcatgcagcgaggacaatagaattttactctgggatacccgctgtcccaagccagcatcacagattggctgcagtgcgcctggctaccttcctacctcgctggcttggcatcctcagcaaagtgaagtctttgtctttggtgatgagaatgggacagtctcccttgtggacaccaagagtacaagctgtgtcctgagctcagctgtacactcccagtgtgtcactgggctggtgttctccccacacagtgttcccttcctggcctctctcagtgaagactgctcacttgctgtgctggactcaagcctttctgagttgtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccctagtgatgggacatatatgagagagaagtgtttttctatcatagacaccataggggaaagtttggggatgaaggagagcttaaaggtgtttcaattaagttagaaaactgacacaggctgttgagaattctttgccacttttcccaccccaaaacagcatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgtt

SEQ ID NO: 369815 - DNA, 1742 bp, Homo sapiens
  misc_feature (2)..(2): n is a, c, g, or t
anctgaatctactcacaacgcacaatacatgtccatttttaagaaagcttttcctccctgtgactacaggaacccagaatccagcctccctcaggctgagagacgatgcctattaacggcacagaacatgatgacattgtgtctacagtcagtgtcttgagctctggcacacaagctgtcagtggtagcaaagacatctgcatcaaggtttgggaccttgctcagcaggtggtactgagttcataccgagctcatgctgctcaggtcacttgtgttgctgcctctcctcacaaggactctgtgtttctttcatgcagcgaggacaatagaattttactctgggatacccgctgtcccaagccagcatcacagattggctgcagtgcgcctggctaccttcctacctcgctggcttggcatcctcagcaaagtgaagtctttgtctttggtgatgagaatgggacagtctcccttgtggacaccaagagtacaagctgtgtcctgagctcagctgtacactcccagtgtgtcactgggctggtgttctccccacacagtgttcccttcctggcctctctcagtgaagactgctcacttgctgtgctggactcaagcctttctgagttgtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccctagtgatgggacatatatgagagagaagtgtttttctatcatagacaccataggggaaagtttggggatgaaggagagcttaaaggtgtttcaattaagttagaaaactgacacaggctgttgagaattctttgccacttttcccaccccaaaacagcatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgtt

SEQ ID NO: 369816 - DNA, 1446 bp, Homo sapiens
agcggaagtagagttgcggttccctcgggagaggggcggaggctcagaggtgcaccacgtggggtttgctgccggagcggagtctccggccggcgtccagtttgagtctaggttggagttggaaccgtggagatgcggaaggaaaccccaccccccctagtgcccccggcggcccgggagtggaatcttcccccaaatgcgcccgcctgcatggaacggcagttggaggctgcgcggtaccggtccgatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctgcatcaaggtttgggaccttgctcagcaggtggtactgagttcataccgagctcatgctgctcaggtcacttgtgttgctgcctctcctcacaaggactctgtgtttctttcatgcagcgaggacaatagaattttactctgggatacccgctgtcccaagccagcatcacagattggctgcagtgcgcctggctaccttcctacctcgctggcttggcatcctcagcaaagtgaagtctttgtctttggtgatgagaatgggacagtctcccttgtggacaccaagagtacaagctgtgtcctgagctcagctgtacactcccagtgtgtcactgggctggtgttctccccacacagtgttcccttcctggcctctctcagtgaagactgctcacttgctgtgctggactcaagcctttctgagttgtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatactgttctctggtccaccaagggctatgaggctcaccccttggatggtgctcagaaccacaaggaatactgaagaagccttgcctatgatttcaggtggcatcagacattgggctaattttcaaggtgtctctccttcccaacaggacagtcggagtctggttctttaataaatagctatatggatcttactta

SEQ ID NO: 369817 - DNA, 1665 bp, Homo sapiens
agcggaagtagagttgcggttccctcgggagaggggcggaggctcagaggtgcaccacgtggggtttgctgccggagcggagtctccggccggcgtccagtttgagtctaggttggagttggaaccgtggagatgcggaaggaaaccccaccccccctagtgcccccggcggcccgggagtggaatcttcccccaaatgcgcccgcctgcatggaacggcagttggaggctgcgcggtaccggtccgatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctgcatcaaggtttgggaccttgctcagcaggtggtactgagttcataccgagctcatgctgctcaggtcacttgtgttgctgcctctcctcacaaggactctgtgtttctttcatgcagcgaggacaatagaattttactctgggatacccgctgtcccaagccagcatcacagattggctgcagtgcgcctggctaccttcctacctcgctggcttggcatcctcagcaaagtgaagtctttgtctttggtgatgagaatgggacagtctcccttgtggacaccaagagtacaagctgtgtcctgagctcagctgtacactcccagtgtgtcactgggctggtgttctccccacacagtgttcccttcctggcctctctcagtgaagactgctcacttgctgtgctggactcaagcctttctgagttcatttcttcatctatgaaaatagaagactggattggatgactgatgacatccactgtggatagctacactgctatcctggcgatgaggccatacagttggtgaaatgtgtgtaacacacccaaaaaatgtgccccagatgtgttgggttctctttttttctccaggtctgcttttcttgtctctactctgccccgactttttttctttcttctaggtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttcccta

SEQ ID NO: 369818 - DNA, 1420 bp, Homo sapiens
tgatgttatccccaacacagtgttcccttcctggcctctctcagtgaagactgctcacttgctgtgctggactcaagcctttctgagttcatttcttcatctatgaaaatagaagactggattggatgactgatgacatccactgtggatagctacactgctatcctggcgatgaggccatacagttggtgaaatgtgtgtaacacacccaaaaaatgtgccccagatgtgttgggttctctttttttctccaggtctgcttttcttgtctctactctgccccgactttttttctttcttctaggtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccctagtgatgggacatatatgagagagaagtgtttttctatcatagacaccataggggaaagtttggggatgaaggagagcttaaaggtgtttcaattaagttagaaaactgacacaggctgttgagaattctttgccacttttcccaccccaaaacagcatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgtt

SEQ ID NO: 369819 - DNA, 1193 bp, Homo sapiens
atataacacaagacttgcacatacatagatggctggtacattgctgtgctggaatcacgcctatctgtatagtaaaggtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccctagtgatgggacatatatgagagagaagtgtttttctatcatagacaccataggggaaagtttggggatgaaggagagcttaaaggtgtttcaattaagttagaaaactgacacaggctgttgagaattctttgccacttttcccaccccaaaacagcatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgtt

SEQ ID NO: 369820 - DNA, 968 bp, Homo sapiens
agcggaagtagagttgcggttccctcgggagaggggcggaggctcagaggtgcaccacgtggggtttgctgccggagcggagtctccggccggcgtccagtttgagtctaggttggagttggaaccgtggagatgcggaaggaaaccccaccccccctagtgcccccggcggcccgggagtggaatcttcccccaaatgcgcccgcctgcatggaacggcagttggaggctgcgcggtaccggtccgatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctgcatcaaggtttgggaccttgctcagcaggtggtactgagttcataccgagctcatgctgctcaggtcacttgtgttgctgcctctcctcacaaggactctgtgtttctttcatgcagcgaggacaatagaattttactctgggatacccgctgtcccaagccagcatcacagattggctgcagtgcgcctggctaccttcctacctcgctggcttggcatcctcagcaaagtgaagtctttgtctttggtgatgagaatgggacagtctcccttgtggacaccaagagtacaagctgtgtcctgagctcagctgtacactcccagtgtgtcactgggctggtgttctccccacacaggtactgttctttgtcatcaggggcctgatgggtata

SEQ ID NO: 369821 - DNA, 812 bp, Homo sapiens
ccagtgacacactgggagtgtacagctgagctcaggacacagcttgtactcttggtgtccacaagggagactgtcccattctcatcaccaaagacaaagacttcactttgctgaggatgccaagcctttctgagttgtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaatgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccctagtgatgggacatatatgagagagaagtgtttttctatcatagacaccataggggaaagtttggggatgaaggagagcttaaaggtgtttcaattaagttagaaaactgacacaggctgttgagaattctttgccacttttcccaccccaaaacagcatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgtt

SEQ ID NO: 369822 - DNA, 941 bp, Homo sapiens
agcggaagtagagttgcggttccctcgggagaggggcggaggctcagaggtgcaccacgtggggtttgctgccggagcggagtctccggccggcgtccagtttgagtctaggttggagttggaaccgtggagatgcggaaggaaaccccaccccccctagtgcccccggcggcccgggagtggaatcttcccccaaatgcgcccgcctgcatggaacggcagttggaggctgcgcggtaccggtccgatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctgcatcaagttgcggaccttgctcagcagggtggtactggagttcataccgaggctccatgctggtccaggtccctttgtgtttgctgctctacttcaaagggctccgggttccttttcatggcgggggaatagaattaagctcgggaacccgtgtcccagcgcagtaagattgggggcagggcgcgggagcctcaacaccggcggggccccacaagagagtctgttttgggcgaaagagaggcactcctgggcgaatactgtgtggcgcaagaccaccgtgagtagtccaacagcaacgcgctcacatctgttgtgcatttttctcattatctcctcttgtttgtcgcacgatcctctgcttgagga

SEQ ID NO: 369823 - DNA, 878 bp, Homo sapiens
agcggaagtagagttgcggttccctcgggagaggggcggaggctcagaggtgcaccacgtggggtttgctgccggagcggagtctccggccggcgtccagtttgagtctaggttggagttggaaccgtggagatgcggaaggaaaccccacggtggcgcaggagccgaggctgggactcgagcggagtgggagtgtgacctcgccaaggaggcgccctgcggacgcaggtaggagccagggtgctatggacggaggcccaggtgaaacgtctccgactgggtggacaccattcacatcgtgtggcctgaaagcaatcgatgttggcgcgcgtgaactcgtgttgcgggaggctccggttgccagggtgcctctcttatacaccgcggaccgccctgatcgggcggacacgcgcaaagggacaaccgtgtgacatgcctcccggacgaagagtcccatgacgcgaaggcggtgcgcaggtggcctggagactccacgtgagggggaaccgagcgagaaggagtagggactactagcacaggccggaccatgccgggaagagggtggccagcagggacgcaggccgaggcaaggggaggaaccccccaaaatgggttagcccacaaagaagaaggagaaggtgtacgagcgagccgcccaggggactggaacaccccagggagatgggaattgaattggaccacgcgccaaccactggggccgcaacgaggcagcggcggcccggaccacagggcacgaaggacagagagcggatggaccacgaggggggaaagcgcgcccactgccgaaagaagaaccctcgcgcccatcacgtgcggggcggcaccacggcaacccgccaacatgacgcagggacaca

SEQ ID NO: 369824 - DNA, 2223 bp, Homo sapiens
agcggaagtagagttgcggttccctcgggagaggggcggaggctcagaggtgcaccacgtggggtttgctgccggagcggagtctccggccggcgtccagtttgagtctaggttggagttggaaccgtggagatgcggaaggaaaccccaccccccctagtgcccccggcggcccgggagtggaatcttcccccaaatgcgcccgcctgcatggaacggcagttggaggctgcgcggtaccggtccgatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctgcatcaaggtttgggaccttgctcagcaggtggtactgagttcataccgagctcatgctgctcaggtcacttgtgttgctgcctctcctcacaaggactctgtgtttctttcatgcagcgaggacaatagaattttactctgggatacccgctgtcccaagccagcatcacagattggctgcagtgcgcctggctaccttcctacctcgctggcttggcatcctcagcaaagtgaagtctttgtctttggtgatgagaatgggacagtctcccttgtggacaccaagagtacaagctgtgtcctgagctcagctgtacactcccagtgtgtcactgggctggtgttctccccacacagtgttcccttcctggcctctctcagtgaagactgctcacttgctgtgctggactcaagcctttctgagttcatttcttcatctatgaaaatagaagactggattggatgactgatgacatccactgtggatagctacactgctatcctggcgatgaggccatacagttggtgaaatgtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccctagtgatgggacatatatgagagagaagtgtttttctatcatagacaccataggggaaagtttggggatgaaggagagcttaaaggtgtttcaattaagttagaaaactgacacaggctgttgagaattctttgccacttttcccaccccaaaacagcatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgtt

SEQ ID NO: 369825 - DNA, 2481 bp, Homo sapiens
agcggaagtagagttgcggttccctcgggagaggggcggaggctcagaggtgcaccacgtggggtttgctgccggagcggagtctccggccggcgtccagtttgagtctaggttggagttggaaccgtggagatgcggaaggaaaccccaccccccctagtgcccccggcggcccgggagtggaatcttcccccaaatgcgcccgcctgcatggaacggcagttggaggctgcgcggtaccggtccgatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctgcatcaaggtttgggaccttgctcagcaggtggtactgagttcataccgagctcatgctgctcaggtcacttgtgttgctgcctctcctcacaaggactctgtgtttctttcatgcagcgaggacaatagaattttactctgggatacccgctgtcccaagccagcatcacagattggctgcagtgcgcctggctaccttcctacctcgctggcttggcatcctcagcaaagtgaagtctttgtctttggtgatgagaatgggacagtctcccttgtggacaccaagagtacaagctgtgtcctgagctcagctgtacactcccagtgtgtcactgggctggtgttctccccacacagtgttcccttcctggcctctctcagtgaagactgctcacttgctgtgctggactcaagcctttctgagttgtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccctagtgatgggacatatatgagagagaagtgtttttctatcatagacaccataggggaaagtttggggatgaaggagagcttaaaggtgtttcaattaagttagaaaactgacacaggctgttgagaattctttgccacttttcccaccccaaaacagcatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgttggcctgtcttttttgaagcatgtgtgttatgtgtagttagatatatttcacttatgtgagtcatcatggtgttggtcttgtagcccattatttttcctgtgcttccccagcttcccaaagtagctagttagaacttaaggtaaatatttattcttgggttggtggagtggatattgccagttaggagtcatggatcaattactgattatattgaaagtaaatataatcaattatgtacttttgagctttgcaggttcaatttaggtaaaaatcacattatgaaactgggaaagtctgaaggaatatgggcaaaatatttctcagtaaagcttccatgcttcacccttgacatgattacccttga

SEQ ID NO: 369826 - DNA, 1746 bp, Homo sapiens
agcggaagtagagttgcggttccctcgggagaggggcggaggctcagaggtgcaccacgtggggtttgctgccggagcggagtctccggccggcgtccagtttgagtctaggttggagttggaaccgtggagatgcggaaggaaaccccaccccccctagtgcccccggcggcccgggagtggaatcttcccccaaatgcgcccgcctgcatggaacggcagttggaggctgcgcggtaccggtccgatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctgcatcaaggtttgggaccttgctcagcaggtggtactgagttcataccgagctcatgctgctcaggtcacttgtgttgctgcctctcctcacaaggactctgtgtttctttcatgcagcgaggacaatagaattttactctgggatacccgctgtcccaagccagcatcacagattggctgcagtgcgcctggctaccttcctacctcgctggcttggcatcctcagcaaagtgaagtctttgtctttggtgatgagaatgggacagtctcccttgtggacaccaagagtacaagctgtgtcctgagctcagctgtacactcccagtgtgtcactgggctggtgttctccccacacagtgttcccttcctggcctctctcagtgaagactgctcacttgctgtgctggactcaagcctttctgagttgtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttggtacggttttacacaactccttaccattaaactgaatcagaaatcca

SEQ ID NO: 369827 - DNA, 2423 bp, Homo sapiens
agcggaagtagagttgcggttccctcgggagaggggcggaggctcagaggtgcaccacgtggggtttgctgccggagcggagtctccggccggcgtccagtttgagtctaggttggagttggaaccgtggagatgcggaaggaaaccccaccccccctagtgcccccggcggcccgggagtggaatcttcccccaaatgcgcccgcctgcatggaacggcagttggaggctgcgcggtaccggtccgatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctgcatcaaggtttgggaccttgctcagcaggtggtactgagttcataccgagctcatgctgctcaggtcacttgtgttgctgcctctcctcacaaggactctgtgtttctttcatgcagcgaggacaatagaattttactctgggatacccgctgtcccaagccagcatcacagattggctgcagtgcgcctggctaccttcctacctcgctggcttggcatcctcagcaaagtgaagtctttgtctttggtgatgagaatgggacagtctcccttgtggacaccaagagtacaagctgtgtcctgagctcagctgtacactcccagtgtgtcactgggctggtgttctccccacacagtgttcccttcctggcctctctcagtgaagactgctcacttgctgtgctggactcaagcctttctgagttgtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccctagtgatgggacatatatgagagagaagtgtttttctatcatagacaccataggggaaagtttggggatgaaggagagcttaaaggtgtttcaattaagttagaaaactgacatcttctgccctggtcccctttctcttgatgtggaaagtctgaatgcagtatttatagacttctaaggttttaaaatccagtatcaagaagaaaatcagaaatactggttggtgaaataaagagtttaggcattgttggcctgtcttttttgaagcatgtgtgttatgtgtagttagatatatttcacttatgtgagtcatcatggtgttggtcttgtagcccattatttttcctgtgcttccccagcttcccaaagtagctagttagaacttaaggtaaatatttattcttgggttggtggagtggatattgccagttaggagtcatggatcaattactgattatattgaaagtaaatataatcaattatgtacttttgagctttgcaggttcaatttaggtaaaaatcacattatgaaactgggaaagtctgaaggaatatgggcaaaatatttctcagtaaagcttccatgcttcacccttgacatgattacccttga

SEQ ID NO: 369828 - DNA, 2336 bp, Homo sapiens
agcggaagtagagttgcggttccctcgggagaggggcggaggctcagaggtgcaccacgtggggtttgctgccggagcggagtctccggccggcgtccagtttgagtctaggttggagttggaaccgtggagatgcggaaggaaaccccaccccccctagtgcccccggcggcccgggagtggaatcttcccccaaatgcgcccgcctgcatggaacggcagttggaggctgcgcggtaccggtccgatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctgcatcaaggtttgggaccttgctcagcaggtggtactgagttcataccgagctcatgctgctcaggtcacttgtgttgctgcctctcctcacaaggactctgtgtttctttcatgcagcgaggacaatagaattttactctgggatacccgctgtcccaagccagcatcacagattggctgcagtgcgcctggctaccttcctacctcgctggcttggcatcctcagcaaagtgaagtctttgtctttggtgatgagaatgggacagtctcccttgtggacaccaagagtacaagctgtgtcctgagctcagctgtacactcccagtgtgtcactgggctggtgttctccccacacagtgttcccttcctggcctctctcagtgaagactgctcacttgctgtgctggactcaagcctttctgagttgtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctgctctgaccagcaccatggcggttggcaagaacaagcgccttacgaaaggcggcaaaaagggagccttgaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgtactgtgatggttttactaaaaaacgcaacaatcagatacggaagacctcttatgctcagcaccaaacaggtccgccaaatccggaagaagatgatggaaatcatga

SEQ ID NO: 369829 - DNA, 1881 bp, Homo sapiens
agcggaagtagagttgcggttccctcgggagaggggcggaggctcagaggtgcaccacgtggggtttgctgccggagcggagtctccggccggcgtccagtttgagtctaggttggagttggaaccgtggagatgcggaaggaaaccccaccccccctagtgcccccggcggcccgggagtggaatcttcccccaaatgcgcccgcctgcatggaacggcagttggaggctgcgcggtaccggtccgatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctgcatcaaggtttgggaccttgctcagcaggtggtactgagttcataccgagctcatgctgctcaggtcacttgtgttgctgcctctcctcacaaggactctgtgtttctttcatgcagcgagtgttcccttcctggcctctctcagtgaagactgctcacttgctgtgctggactcaagcctttctgagttgtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccctagtgatgggacatatatgagagagaagtgtttttctatcatagacaccataggggaaagtttggggatgaaggagagcttaaaggtgtttcaattaagttagaaaactgacacaggctgttgagaattctttgccacttttcccaccccaaaacagcatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgtt

SEQ ID NO: 369830 - DNA, 1816 bp, Homo sapiens
agtgatccaggcccatcgcggtcaaagcctccaacagctacagcacaacaccatcagtttgcgatggctggggggccttctggaagaagagaggcaaagaaagtctgaagacaagccatgctgtgctcataaaggaggggctggtctgctcgccaatctagtacatccctgtctggagggaggtggttggggtcttcagtttcaggatcagtgccttcctgtaagttattgttggggtcctgatttacaacgtcaggagtagcaaagacatctgcatcaaggtttgggaccttgctcagcaggtggtactgagttcataccgagctcatgctgctcaggtcacttgtgttgctgcctctcctcacaaggactctgtgtttctttcatgcagcgaggacaatagaattttactctgggatacccgctgtcccaagccagcatcacagattggctgcagtgcgcctggctaccttcctacctcgctggcttggcatcctcagcaaagtgaagtctttgtctttggtgatgagaatgggacagtctcccttgtggacaccaagagtacaagctgtgtcctgagctcagctgtacactcccagtgtgtcactgggctggtgttctccccacacagtgttcccttcctggcctctctcagtgaagactgctcacttgctgtgctggactcaagcctttctgagttgtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccctagtgatgggacatatatgagagagaagtgtttttctatcatagacaccataggggaaagtttggggatgaaggagagcttaaaggtgtttcaattaagttagaaaactgacacaggctgttgagaattctttgccacttttcccaccccaaaacagcatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgtt

SEQ ID NO: 369831 - DNA, 1731 bp, Homo sapiens
tttgggaatcagggaaggggagcagtgggtgggcgagtcattttcctcttcagaaaactgtgttgtgcttttggagaacagattctccatctgtatccgaagggacttggtaatggaagcaggctggctgttgaccctgtccattcctggggcacattcacaaccccaaggacaagccgtgtccttggtagaggggggtggtaggtgaaatttttaagtctagccctccagcgctctcccacaagggggcggcagtctaccctctcacataaagaactgcgtatgaaatgcagcctgctacagggtaaaaggcagcacctggaagacctgaattgtacttccctccttgccgtgatttgctgcctgttactgcccctcatcactgtcttgttctatccagcatttcttcatctatgaaaatagaagactggattggatgactgatgacatccactgtggatagctacactgctatcctggcgatgaggccatacagttggtgaaatgtgtgtaacacacccaaaaaatgtgccccagatgtgttgggttctctttttttctccaggtctgcttttcttgtctctactctgccccgactttttttctttcttctaggtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccctagtgatgggacatatatgagagagaagtgtttttctatcatagacaccataggggaaagtttggggatgaaggagagcttaaaggtgtttcaattaagttagaaaactgacacaggctgttgagaattctttgccacttttcccaccccaaaacagcatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgtt

SEQ ID NO: 369832 - DNA, 799 bp, Homo sapiens
  misc_feature (703)..(703): n is a, c, g, or t
  misc_feature (707)..(707): n is a, c, g, or t
  misc_feature (772)..(772): n is a, c, g, or t
agcggaagtagagttgcggttccctcgggagaggggcggaggctcagaggtgcaccacgtggggtttgctgccggagcggagtctccggccggcgtccagtttgagtctaggttggagttggaaccgtggagatgcggaaggaaaccccaccccccctagtgcccccggcggcccgggagtggaatcttcccccaaatgcgcccgcctgcatggaacggcagttggaggctgcgcggtaccggtccgatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctgcatcaaggtttgggaccttgctcagcaggtggtactgagttcataccgagctcatgctgctcaggtcacttgtgttgctgcctctcctcacaaggactctgtgtttctttcatgcagcgagaggaaanatanaattttactctggggaataccccccttgttcccaagcccatcatccacagaattgggttggcaanggcgccctgggctaaccttccctaacc

SEQ ID NO: 369833 - DNA, 3553 bp, Homo sapiens
  misc_feature (161)..(161): n is a, c, g, or t
  misc_feature (325)..(325): n is a, c, g, or t
atgaaagagattgtggatatgacaaaaaaggtctttcagcataaggatcttacagaaattcaagagccagtagacatcacaccagaggaattaacataatataacttgataaagatgagtgctttggaaccagtgctagacagtgaggaagaagactttgnagaaacagtgccaggggccaaatgcagtggctcatgcctgtaatgccagcattttgggaggccaaggtggatggctcacttgagcccaggagttcaagcctgggtaacacggtgaaaccctgtctctacaaaaaatacaaaaaatttagctggatgtggaggtncacgtctgtagtcccagctacatggggggctgaggtggggaagatcagttgagcctgggatgcagtgagccatgatggcaccactgcactccagctgggatgacagagtgagactctatctcaaaaaaaaaaaaaaaaaaaaagtggtgccagaacacaaattgacagtagacaatatggcagaaggttttcaattatcaagactgcttttcacttcttttatcacatggacccttctttgatactggcactgaatctaaagcaaatggtagaagaaagatcagtactatataaaaatgtttttagagaaatgaaacggcaaaaagtcgggcagaaatcatgatgtacttctataaagtcgagtgtgcctgccacttctgcatccccttctacctctttcacccctgcaattcctcagacagcaagaccaacccctcctcttcagcctacccagtgtgaagacaatgaagatgaagacctttgtgataatccacttccacttaatacagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggttcttgaattagtgttggaaaactttgtttatccgtggtacagggatgtgacagatgatgaatcctttgttgatgaactgagaataacattacgtttttttgcatctgtcttaataagaaggattcacaaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacaggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaagtga

SEQ ID NO: 369834 - DNA, 629 bp, Homo sapiens
tttttttttttactgcagcatttctcagagtttgcattatgccttgtgcattgtgaatctccaaaaatgggatacatgatactgcatttgtcaacttgaccatagaaacctcttatccaggagcctcttatagaaacactggtttggggagtattgatttgcagtttttgcctagtatctgggaaacagggtggtgattttgctttatgatccagttaatggtgagtcactttataatataaaattatttcacatttggcctttttgtttagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaagtga

SEQ ID NO: 369835 - DNA, 516 bp, Homo sapiens
tactttccactgcatgaaagaaatggtatgcctaaggacaaagaaaagacagaattatttctggatatttaatttctaagaaccttttttaattatgtagaaaaaagtcagttatttcctgatatatttaatttttttccatgtcacccaagagaaaacatatttaatttttaagaaccgtttttagtaatgtagacttcatccaaacacaaaagacagctatgtgcgtttatcttacctttatcaccttattcatgaagatttcttccctttgcaaaaatgaatgttatacacctgtgtaacttctgaagcttttaaattttgttttgtgttctaaaatgaagtttatataatatctgggctttctttctttcctctccttatattatttcacatacctgttattgcagaggtagcctaagtttggatgattttcggtaagtcttgagcatgtgattcttttcagtattaaatgtttttagaaagtacattgtgaacaacctaatacaaataaaa

SEQ ID NO: 369836 - DNA, 530 bp, Homo sapiens
aaaaaaattttcaagttattgtgatattaagtgcatattaaaacagagtggcagttacagactttgtatctttaattttcatgggaatcaacaacaggaaacctttagctctgtttgagacttcataacagagctgtcattaaacgttgccttttttctcatatctagaacatagatatttctcactccatatgccagccaatttattttggtttacaatatatatgtcttaggttagaattttaatacactagagctgttaggcaatttacaaatgaacctgtgtcttgtcttctattaaatggatttatttttactttaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaagtga

SEQ ID NO: 369837 - DNA, 3923 bp, Homo sapiens
attgaaactatagtactgtacctacaccatggggtgaatgcatgaaggtcaaatgaaagtgcttagtgtctgtaccgcctaagtaaattttcgcgataatagtcttcctgcatctctcactgtagcggacaatacagaaaaaaaaatttagaaatgtgatgaattagtaaagggaaaaccccatgagactctataagagggattttacctaatctgccaacctgcctcttccaagcactcggattttggttgggctcccggagccggcgtgaattgagctctacccttgcccgtgagcgcgcaaaagagattttgttggtggggtggcggcctgatgagttgtagtctttattctagggctgttttactcgccacccccccagcccccaacacaccccttttaaaataccgactcaaaggcgtcctcctatccccctctcccttaggcgtcacgcaaagctcggacctgctcccacccggagccgagtgtacggtgaggcgcggagcgttgcggggtcggggaagcgctaccacccgctccatccctctgcgggttcgtgtcacgaagactacagttcccagcgggctccacgagctccggttgcccctcaggcagcgcccggcggctacgggggtgctgtagtttcttccgggctccctacaaccttcttccctctcctccgcaatacaggcagttactgggtgctggggctgtcctttgatttccggaaatggccggtcgccagtgttgtcagagtttccacggaagactgcgcgctactccggccaggagggcggagcggcgagacgctagaggctttgcgctgggtgacgacttcgggcacgttctacggccgttcctctggtcggctggggaccgcggccgcgcacgcgcggcggggggcgtggggctgggcccagccggacgcgacctcagcctgcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacaggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaagtga

SEQ ID NO: 369838 - DNA, 4082 bp, Homo sapiens
attgaaactatagtactgtacctacaccatggggtgaatgcatgaaggtcaaatgaaagtgcttagtgtctgtaccgcctaagtaaattttcgcgataatagtcttcctgcatctctcactgtagcggacaatacagaaaaaaaaatttagaaatgtgatgaattagtaaagggaaaaccccatgagactctataagagggattttacctaatctgccaacctgcctcttccaagcactcggattttggttgggctcccggagccggcgtgaattgagctctacccttgcccgtgagcgcgcaaaagagattttgttggtggggtggcggcctgatgagttgtagtctttattctagggctgttttactcgccacccccccagcccccaacacaccccttttaaaataccgactcaaaggcgtcctcctatccccctctcccttaggcgtcacgcaaagctcggacctgctcccacccggagccgagtgtacggtgaggcgcggagcgttgcggggtcggggaagcgctaccacccgctccatccctctgcgggttcgtgtcacgaagactacagttcccagcgggctccacgagctccggttgcccctcaggcagcgcccggcggctacgggggtgctgtagtttcttccgggctccctacaaccttcttccctctcctccgcaatacaggcagttactgggtgctggggctgtcctttgatttccggaaatggccggtcgccagtgttgtcagagtttccacggaagactgcgcgctactccggccaggagggcggagcggcgagacgctagaggctttgcgctgggtgacgacttcgggcacgttctacggccgttcctctggtcggctggggaccgcggccgcgcacgcgcggcggggggcgtggggctgggcccagccggacgcgacctcagcctgcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggttcttgaattagtgttggaaaactttgtttatccgtggtacagggatgtgacagatgatgaatcctttgttgatgaactgagaataacattacgtttttttgcatctgtcttaataagaaggattcacaaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacagaggtagcctaagtttggatgattttcggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaagtga

SEQ ID NO: 369839 - DNA, 4230 bp, Homo sapiens
attgaaactatagtactgtacctacaccatggggtgaatgcatgaaggtcaaatgaaagtgcttagtgtctgtaccgcctaagtaaattttcgcgataatagtcttcctgcatctctcactgtagcggacaatacagaaaaaaaaatttagaaatgtgatgaattagtaaagggaaaaccccatgagactctataagagggattttacctaatctgccaacctgcctcttccaagcactcggattttggttgggctcccggagccggcgtgaattgagctctacccttgcccgtgagcgcgcaaaagagattttgttggtggggtggcggcctgatgagttgtagtctttattctagggctgttttactcgccacccccccagcccccaacacaccccttttaaaataccgactcaaaggcgtcctcctatccccctctcccttaggcgtcacgcaaagctcggacctgctcccacccggagccgagtgtacggtgaggcgcggagcgttgcggggtcggggaagcgctaccacccgctccatccctctgcgggttcgtgtcacgaagactacagttcccagcgggctccacgagctccggttgcccctcaggcagcgcccggcggctacgggggtgctgtagtttcttccgggctccctacaaccttcttccctctcctccgcaatacaggcagttactgggtgctggggctgtcctttgatttccggaaatggccggtcgccagtgttgtcagagtttccacggaagactgcgcgctactccggccaggagggcggagcggcgagacgctagaggctttgcgctgggtgacgacttcgggcacgttctacggccgttcctctggtcggctggggaccgcggccgcgcacgcgcggcggggggcgtggggctgggcccagccggacgcgacctcagcctgcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacaggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaagtgattgagtctcatagtctttcatttgctagctgtgatccaaattttattagaacataagtcacttgttattgccatttttaaaagagaaaattcataatgatgttatggcaaacagataagactgataaacttcgtattgtatagctttgaaaataattatgcctagtatggagaaacaggaataagatctgattttcttagagttaatatattttagtagattggttttccttttttttattttgtacatagttaactgtgtatctataaataaagcatcctatatgagtttttaataataaaaaaag

SEQ ID NO: 369840 - DNA, 3869 bp, Homo sapiens
attgaaactatagtactgtacctacaccatggggtgaatgcatgaaggtcaaatgaaagtgcttagtgtctgtaccgcctaagtaaattttcgcgataatagtcttcctgcatctctcactgtagcggacaatacagaaaaaaaaatttagaaatgtgatgaattagtaaagggaaaaccccatgagactctataagagggattttacctaatctgccaacctgcctcttccaagcactcggattttggttgggctcccggagccggcgtgaattgagctctacccttgcccgtgagcgcgcaaaagagattttgttggtggggtggcggcctgatgagttgtagtctttattctagggctgttttactcgccacccccccagcccccaacacaccccttttaaaataccgactcaaaggcgtcctcctatccccctctcccttaggcgtcacgcaaagctcggacctgctcccacccggagccgagtgtacggtgaggcgcggagcgttgcggggtcggggaagcgctaccacccgctccatccctctgcgggttcgtgtcacgaagactacagttcccagcgggctccacgagctccggttgcccctcaggcagcgcccggcggctacgggggtgctgtagtttcttccgggctccctacaaccttcttccctctcctccgcaatacaggcagttactgggtgctggggctgtcctttgatttccggaaatggccggtcgccagtgttgtcagagtttccacggaagactgcgcgctactccggccaggagggcggagcggcgagacgctagaggctttgcgctgggtgacgacttcgggcacgttctacggccgttcctctggtcggctggggaccgcggccgcgcacgcgcggcggggggcgtggggctgggcccagccggacgcgacctcagcctgcggcggctaactgccggtaggcgttctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggttcttgaattagtgttggaaaactttgtttatccgtggtacagggatgtgacagatgatgaatcctttgttgatgaactgagaataacattacgtttttttgcatctgtcttaataagaaggattcacaaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacagaggtagcctaagtttggatgattttcggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaagtga

SEQ ID NO: 369841 - DNA, 3213 bp, Homo sapiens
attattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcgggggaaaaggggtcgaggccggtcctgacctgttacaatgaagactgacttgctatgtgggattacaccagaagcttgcagtggagtaatggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggttcttgaattagtgttggaaaactttgtttatccgtggtacagggatgtgacagatgatgaatcctttgttgatgaactgagaataacattacgtttttttgcatctgtcttaataagaaggattcacaaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacagaggtagcctaagtttggatgattttcggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaagtga

SEQ ID NO: 369842 - DNA, 1643 bp, Homo sapiens
gtttatcattttcaaaactgtttttcttttttttaataatggttttcaataaactagactgttgtgataatttgctatgtacttgatacatttttgtttaatattcaggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaagtga

SEQ ID NO: 369843 - DNA, 1602 bp, Homo sapiens
actccgacctcccaccaagctccattcaaaattgaacagaggtagcctaagatttggatgattttcggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaagtga

SEQ ID NO: 369844 - DNA, 1285 bp, Homo sapiens
aatgttatgtatcataaacttcaacgcccaagtagaaacaaatgcagtagactgtcaacgactctcttaatttaccccgctacagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaagtga

SEQ ID NO: 369845 - DNA, 4551 bp, Homo sapiens
attgaaactatagtactgtacctacaccatggggtgaatgcatgaaggtcaaatgaaagtgcttagtgtctgtaccgcctaagtaaattttcgcgataatagtcttcctgcatctctcactgtagcggacaatacagaaaaaaaaatttagaaatgtgatgaattagtaaagggaaaaccccatgagactctataagagggattttacctaatctgccaacctgcctcttccaagcactcggattttggttgggctcccggagccggcgtgaattgagctctacccttgcccgtgagcgcgcaaaagagattttgttggtggggtggcggcctgatgagttgtagtctttattctagggctgttttactcgccacccccccagcccccaacacaccccttttaaaataccgactcaaaggcgtcctcctatccccctctcccttaggcgtcacgcaaagctcggacctgctcccacccggagccgagtgtacggtgaggcgcggagcgttgcggggtcggggaagcgctaccacccgctccatccctctgcgggttcgtgtcacgaagactacagttcccagcgggctccacgagctccggttgcccctcaggcagcgcccggcggctacgggggtgctgtagtttcttccgggctccctacaaccttcttccctctcctccgcaatacaggcagttactgggtgctggggctgtcctttgatttccggaaatggccggtcgccagtgttgtcagagtttccacggaagactgcgcgctactccggccaggagggcggagcggcgagacgctagaggctttgcgctgggtgacgacttcgggcacgttctacggccgttcctctggtcggctggggaccgcggccgcgcacgcgcggcggggggcgtggggctgggcccagccggacgcgacctcagcctgcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggttcttgaattagtgttggaaaactttgtttatccgtggtacagggatgtgacagatgatgaatcctttgttgatgaactgagaataacattacgtttttttgcatctgtcttaataagaaggattcacaaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacagaggtagcctaagtttggatgattttcggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtaactgaaaagcagtaattttattcatgattttcttaatggtatgctgacatttattttaattagggacataaatgtaagaaaacccttgtctctgttctctgtggttctttaaaaaattaacctcagcaaattgccttttgtattttctttattaaacatgcccaaacaattctgggggacagctattgaatagcttctgctttgacttcatccctttttaattacaagcagatagggaccctatatagtctttccaggggaagaagtgagtgtaagtcctagcactagaataggccaagctcagtgttatcgtctgcaccattgtatgctgtgtaagtcagaaactagagtatttttgaagcaagttttatgtaaacccaagcacaaaatgaactaaaattagagcatggtcatattattactatgttgaatcttgaggattttgagttttgagcaaaggtttaagtcattattttctgtcttattttttgactaatccttttggttggatgaaacaactgttgttcagtgctgtggtattgaaatgaagtgtgacttttgtagagtagaggaaaccagatttgggctatttacttattataaactttcaagttgactgggcacggtggctcacgcctgtaatcccagcaccttgggaggccaaggcgggggga

SEQ ID NO: 369846 - DNA, 4191 bp, Homo sapiens
attgaaactatagtactgtacctacaccatggggtgaatgcatgaaggtcaaatgaaagtgcttagtgtctgtaccgcctaagtaaattttcgcgataatagtcttcctgcatctctcactgtagcggacaatacagaaaaaaaaatttagaaatgtgatgaattagtaaagggaaaaccccatgagactctataagagggattttacctaatctgccaacctgcctcttccaagcactcggattttggttgggctcccggagccggcgtgaattgagctctacccttgcccgtgagcgcgcaaaagagattttgttggtggggtggcggcctgatgagttgtagtctttattctagggctgttttactcgccacccccccagcccccaacacaccccttttaaaataccgactcaaaggcgtcctcctatccccctctcccttaggcgtcacgcaaagctcggacctgctcccacccggagccgagtgtacggtgaggcgcggagcgttgcggggtcggggaagcgctaccacccgctccatccctctgcgggttcgtgtcacgaagactacagttcccagcgggctccacgagctccggttgcccctcaggcagcgcccggcggctacgggggtgctgtagtttcttccgggctccctacaaccttcttccctctcctccgcaatacaggcagttactgggtgctggggctgtcctttgatttccggaaatggccggtcgccagtgttgtcagagtttccacggaagactgcgcgctactccggccaggagggcggagcggcgagacgctagaggctttgcgctgggtgacgacttcgggcacgttctacggccgttcctctggtcggctggggaccgcggccgcgcacgcgcggcggggggcgtggggctgggcccagccggacgcgacctcagcctgcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggttcttgaattagtgttggaaaactttgtttatccgtggtacagggatgtgacagatgatgaatcctttgttgatgaactgagaataacattacgtttttttgcatctgtcttaataagaaggattcacaaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacagaggtagcctaagtttggatgattttcggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaagtgattgagtctcatagtctttcatttgctagctgtgatccaaattttattagaacataagtcacttgttattgccatttttaaaagagaaaattcataatgatgttatggcaaacagataagactgataaacttcgtattgtatagctttgaaaataattatgcctagtatggagaaacaggaataagatctgattttcttagagttaatatattttagtagattggttttccttttttttattttgtacatagttaactgtgtatctataaataaagcatcctatatgagtttttaataataaaaaaag

SEQ ID NO: 369847 - DNA, 3884 bp, Homo sapiens
attgaaactatagtactgtacctacaccatggggtgaatgcatgaaggtcaaatgaaagtgcttagtgtctgtaccgcctaagtaaattttcgcgataatagtcttcctgcatctctcactgtagcggacaatacagaaaaaaaaatttagaaatgtgatgaattagtaaagggaaaaccccatgagactctataagagggattttacctaatctgccaacctgcctcttccaagcactcggattttggttgggctcccggagccggcgtgaattgagctctacccttgcccgtgagcgcgcaaaagagattttgttggtggggtggcggcctgatgagttgtagtctttattctagggctgttttactcgccacccccccagcccccaacacaccccttttaaaataccgactcaaaggcgtcctcctatccccctctcccttaggcgtcacgcaaagctcggacctgctcccacccggagccgagtgtacggtgaggcgcggagcgttgcggggtcggggaagcgctaccacccgctccatccctctgcgggttcgtgtcacgaagactacagttcccagcgggctccacgagctccggttgcccctcaggcagcgcccggcggctacgggggtgctgtagtttcttccgggctccctacaaccttcttccctctcctccgcaatacaggcagttactgggtgctggggctgtcctttgatttccggaaatggccggtcgccagtgttgtcagagtttccacggaagactgcgcgctactccggccaggagggcggagcggcgagacgctagaggctttgcgctgggtgacgacttcgggcacgttctacggccgttcctctggtcggctggggaccgcggccgcgcacgcgcggcggggggcgtggggctgggcccagccggacgcgacctcagcctgcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggttcttgaattagtgttggaaaactttgtttatccgtggtacagggatgtgacagatgatgaatcctttgttgatgaactgagaataacattacgtttttttgcatctgtcttaataagaaggattcacaaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacagaggtagcctaagtttggatgattttcggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaagtga

SEQ ID NO: 369848 - DNA, 3467 bp, Homo sapiens
attgaaactatagtactgtacctacaccatggggtgaatgcatgaaggtcaaatgaaagtgcttagtgtctgtaccgcctaagtaaattttcgcgataatagtcttcctgcatctctcactgtagcggacaatacagaaaaaaaaatttagaaatgtgatgaattagtaaagggaaaaccccatgagactctataagagggattttacctaatctgccaacctgcctcttccaagcactcggattttggttgggctcccggagccggcgtgaattgagctctacccttgcccgtgagcgcgcaaaagagattttgttggtggggtggcggcctgatgagttgtagtctttattctagggctgttttactcgccacccccccagcccccaacacaccccttttaaaataccgactcaaaggcgtcctcctatccccctctcccttaggcgtcacgcaaagctcggacctgctcccacccggagccgagtgtacggtgaggcgcggagcgttgcggggtcggggaagcgctaccacccgctccatccctctgcgggttcgtgtcacgaagactacagttcccagcgggctccacgagctccggttgcccctcaggcagcgcccggcggctacgggggtgctgtagtttcttccgggctccctacaaccttcttccctctcctccgcaatacaggcagttactgggtgctggggctgtcctttgatttccggaaatggccggtcgccagtgttgtcagagtttccacggaagactgcgcgctactccggccaggagggcggagcggcgagacgctagaggctttgcgctgggtgacgacttcgggcacgttctacggccgttcctctggtcggctggggaccgcggccgcgcacgcgcggcggggggcgtggggctgggcccagccggacgcgacctcagcctgcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggttcttgaattagtgttggaaaactttgtttatccgtggtacagggatgtgacagatgatgaatcctttgttgatgaactgagaataacattacgtttttttgcatctgtcttaataagaaggattcacaaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacagaggtagcctaagtttggatgattttcggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttgtaggttaacctgggttaggtctacctgggggtacgagctcgattgtatctg

SEQ ID NO: 369849 - DNA, 2195 bp, Homo sapiens
attgaaactatagtactgtacctacaccatggggtgaatgcatgaaggtcaaatgaaagtgcttagtgtctgtaccgcctaagtaaattttcgcgataatagtcttcctgcatctctcactgtagcggacaatacagaaaaaaaaatttagaaatgtgatgaattagtaaagggaaaaccccatgagactctataagagggattttacctaatctgccaacctgcctcttccaagcactcggattttggttgggctcccggagccggcgtgaattgagctctacccttgcccgtgagcgcgcaaaagagattttgttggtggggtggcggcctgatgagttgtagtctttattctagggctgttttactcgccacccccccagcccccaacacaccccttttaaaataccgactcaaaggcgtcctcctatccccctctcccttaggcgtcacgcaaagctcggacctgctcccacccggagccgagtgtacggtgaggcgcggagcgttgcggggtcggggaagcgctaccacccgctccatccctctgcgggttcgtgtcacgaagactacagttcccagcgggctccacgagctccggttgcccctcaggcagcgcccggcggctacgggggtgctgtagtttcttccgggctccctacaaccttcttccctctcctccgcaatacaggcagttactgggtgctggggctgtcctttgatttccggaaatggccggtcgccagtgttgtcagagtttccacggaagactgcgcgctactccggccaggagggcggagcggcgagacgctagaggctttgcgctgggtgacgacttcgggcacgttctacggccgttcctctggtcggctggggaccgcggccgcgcacgcgcggcggggggcgtggggctgggcccagccggacgcgacctcagcctgcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggttcttgaattagtgttggaaaactttgtttatccgtggtacagggatgtgacagatgatgaatcctttgttgatgaactgagaataacattacgtttttttgcatctgtcttaataagaaggattcacaaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccagtgagtattgaatatattagaaaacacttcagattgcattgaattttgattttgtatgtcaaatcaagtgggaattttactgagttaataattctctttctttcaaagcctgaaaaagcaactgaaccggcttctcctttggttccattcttgcagaattgcgagaactgaggattctatgctctggcggttgtagagtagtatggagggg

SEQ ID NO: 369850 - DNA, 1395 bp, Homo sapiens
attgaaactatagtactgtacctacaccatggggtgaatgcatgaaggtcaaatgaaagtgcttagtgtctgtaccgcctaagtaaattttcgcgataatagtcttcctgcatctctcactgtagcggacaatacagaaaaaaaaatttagaaatgtgatgaattagtaaagggaaaaccccatgagactctataagagggattttacctaatctgccaacctgcctcttccaagcactcggattttggttgggctcccggagccggcgtgaattgagctctacccttgcccgtgagcgcgcaaaagagattttgttggtggggtggcggcctgatgagttgtagtctttattctagggctgttttactcgccacccccccagcccccaacacaccccttttaaaataccgactcaaaggcgtcctcctatccccctctcccttaggcgtcacgcaaagctcggacctgctcccacccggagccgagtgtacggtgaggcgcggagcgttgcggggtcggggaagcgctaccacccgctccatccctctgcgggttcgtgtcacgaagactacagttcccagcgggctccacgagctccggttgcccctcaggcagcgcccggcggctacgggggtgctgtagtttcttccgggctccctacaaccttcttccctctcctccgcaatacaggcagttactgggtgctggggctgtcctttgatttccggaaatggccggtcgccagtgttgtcagagtttccacggaagactgcgcgctactccggccaggagggcggagcggcgagacgctagaggctttgcgctgggtgacgacttcgggcacgttctacggccgttcctctggtcggctggggaccgcggccgcgcacgcgcggcggggggcgtggggctgggcccagccggacgcgacctcagcctgcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtaacgccgcagcgcggagcctgggcggcggcttttctccgaaggtgcagacgcccggcccgtgctgcttaaccgtgcggaggccgcgtagctgcgggactggggaccagtggggagagcgagctccgcagaggagcggcctcggggagcacggcggagcgtcgaggccggaagcacaggccg

SEQ ID NO: 369851 - DNA, 837 bp, Homo sapiens
aaaaaaattttcaagttattgtgatattaagtgcatattaaaacagagtggcagttacagactttgtatctttaattttcatgggaatcaacaacaggaaacctttagctctgtttgagacttcataacagagctgtcattaaacgttgccttttttctcatatctagaacatagatatttctcactccatatgccagccaatttattttggtttacaatatatatgtcttaggttagaattttaatacactagagctgttaggcaatttacaaatgaacctgtgtcttgtcttctattaaatggatttatttttactttaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaagtgattgagtctcatagtctttcatttgctagctgtgatccaaattttattagaacataagtcacttgttattgccatttttaaaagagaaaattcataatgatgttatggcaaacagataagactgataaacttcgtattgtatagctttgaaaataattatgcctagtatggagaaacaggaataagatctgattttcttagagttaatatattttagtagattggttttccttttttttattttgtacatagttaactgtgtatctataaataaagcatcctatatgagtttttaataataaaaaaag

SEQ ID NO: 369852 - DNA, 346 bp, Homo sapiens
ttagaaatgcagacttttagggcctaaccaagacctactgaattatagtctccattttaacaagatccttacgtaattcacatgcacttgaaagttaagaactaatataaatcactaaatataaacaattattattatttctttttccagatctctgaccttacttataagagagattctgtctggctctgtgttccttccttctttggatttcctagctgatccagtaagacttaagatttttttttaaattgttacaaattacacttaatataacatttagtatcttaaacatttttatgtatatagtcagtgatactgaaaacattcatattgttgtgcaacc

SEQ ID NO: 369853 - DNA, 914 bp, Homo sapiens
  misc_feature (836)..(836): n is a, c, g, or t
  misc_feature (843)..(843): n is a, c, g, or t
aatgttatgtatcataaacttcaacgcccaagtagaaacaaatgcagtagactgtcaacgactctcttaatttaccccgctacagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagaggacntctcaanatgctttttctgggaaacactgacctcttttccaaaaacgcaaggggcaaacaactttgagaatgggattc

SEQ ID NO: 369854 - DNA, 3723 bp, Homo sapiens
attgaaactatagtactgtacctacaccatggggtgaatgcatgaaggtcaaatgaaagtgcttagtgtctgtaccgcctaagtaaattttcgcgataatagtcttcctgcatctctcactgtagcggacaatacagaaaaaaaaatttagaaatgtgatgaattagtaaagggaaaaccccatgagactctataagagggattttacctaatctgccaacctgcctcttccaagcactcggattttggttgggctcccggagccggcgtgaattgagctctacccttgcccgtgagcgcgcaaaagagattttgttggtggggtggcggcctgatgagttgtagtctttattctagggctgttttactcgccacccccccacgggctccacgagctccggttgcccctcaggcagcgcccggcggctacgggggtgctgtagtttcttccgggctccctacaaccttcttccctctcctccgcaatacaggcagttactgggtgctggggctgtcctttgatttccggaaatggccggtcgccagtgttgtcagagtttccacggaagactgcgcgctactccggccaggagggcggagcggcgagacgctagaggctttgcgctgggtgacgacttcgggcacgttctacggccgttcctctggtcggctggggaccgcggccgcgcacgcgcggcggggggcgtggggctgggcccagccggacgcgacctcagcctgcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacaggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaagtga

SEQ ID NO: 369855 - DNA, 3997 bp, Homo sapiens
attgaaactatagtactgtacctacaccatggggtgaatgcatgaaggtcaaatgaaagtgcttagtgtctgtaccgcctaagtaaattttcgcgataatagtcttcctgcatctctcactgtagcggacaatacagaaaaaaaaatttagaaatgtgatgaattagtaaagggaaaaccccatgagactctataagagggattttacctaatctgccaacctgcctcttccaagcactcggattttggttgggctcccggagccggcgtgaattgagctctacccttgcccgtgagcgcgcaaaagagattttgttggtggggtggcggcctgatgagttgtagtctttattctagggctgttttactcgccacccccccagcccccaacacaccccttttaaaataccgactcaaaggcgtcctcctatccccctctcccttaggcgtcacgcaaagctcggacctgctcccacccggagccgagtgtacggtgaggcgcggagcgttgcggggtcggggaagcgctaccacccgctccatccctctgcgggttcgtgtcacgaagactacagttcccagcgggctccacgagctccggttgcccctcaggcagcgcccggcggctacgggggtgctgtagtttcttccgggctccctacaaccttcttccctctcctccgcaatacaggcagttactgggtgctggggctgtcctttgatttccggaaatggccggtcgccagtgttgtcagagtttccacggaagactgcgcgctactccggccaggagggcggagcggcgagacgctagaggctttgcgctgggtgacgacttcgggcacgttctacggccgttcctctggtcggctggggaccgcggccgcgcacgcgcggcggggggcgtggggctgggcccagccggacgcgacctcagcctgcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggttcttgaattagtgttggaaaactttgtttatccgtggtacagggatgtgacagatgatgaatcctttgttgatgaactgagaataacattacgtttttttgcatctgtcttaataagaaggattcacaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacagaggtagcctaagtttggatgattttcggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaagtga

SEQ ID NO: 369856 - DNA, 3792 bp, Homo sapiens
attgaaactatagtactgtacctacaccatggggtgaatgcatgaaggtcaaatgaaagtgcttagtgtctgtaccgcctaagtaaattttcgcgataatagtcttcctgcatctctcactgtagcggacaatacagaaaaaaaaatttagaaatgtgatgaattagtaaagggaaaaccccatgagactctataagagggattttacctaatctgccaacctgcctcttccaagcactcggattttggttgggctcccggagccggcgtgaattgagctctacccttgcccgtgagcgcgcaaaagagattttgttggtggggtggcggcctgatgagttgtagtctttattctagggctgttttactcgccacccccccagcccccaacacaccccttttaaaataccgactcaaaggcgtcctcctatccccctctcccttaggcgtcacgcaaagctcggacctgctcccacccggagccgagtgtacggtgaggcgcggagcgttgcggggtcggggaagcgctaccacccgctccatccctctgcgggttcgtgtcacgaagactacagttcccagcgggctccacgagctccggttgcccctcaggcagcgcccggcggctacgggggtgctgtagtttcttccgggctccctacaaccttcttccctctcctccgcaatacaggcagttactgggtgctggggctgtcctttgatttccggaaatggccggtcgccagtgttgtcagagtttccacggaagactgcgcgctactccggccaggagggcggagcggcgagacgctagaggctttgcgctgggtgacgacttcgggcacgttctacggccgttcctctggtcggctggggaccgcggccgcgcacgcgcggcggggggcgtggggctgggcccagccggacgcgacctcagcctgcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacaggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggaatagctgctgtaggtgggggttcctctag

SEQ ID NO: 369857 - DNA, 3917 bp, Homo sapiens
attgaaactatagtactgtacctacaccatggggtgaatgcatgaaggtcaaatgaaagtgcttagtgtctgtaccgcctaagtaaattttcgcgataatagtcttcctgcatctctcactgtagcggacaatacagaaaaaaaaatttagaaatgtgatgaattagtaaagggaaaaccccatgagactctataagagggattttacctaatctgccaacctgcctcttccaagcactcggattttggttgggctcccggagccggcgtgaattgagctctacccttgcccgtgagcgcgcaaaagagattttgttggtggggtggcggcctgatgagttgtagtctttattctagggctgttttactcgccacccccccagcccccaacacaccccttttaaaataccgactcaaaggcgtcctcctatccccctctcccttaggcgtcacgcaaagctcggacctgctcccacccggagccgagtgtacggtgaggcgcggagcgttgcggggtcggggaagcgctaccacccgctccatccctctgcgggttcgtgtcacgaagactacagttcccagcgggctccacgagctccggttgcccctcaggcagcgcccggcggctacgggggtgctgtagtttcttccgggctccctacaaccttcttccctctcctccgcaatacaggcagttactgggtgctggggctgtcctttgatttccggaaatggccggtcgccagtgttgtcagagtttccacggaagactgcgcgctactccggccaggagggcggagcggcgagacgctagaggctttgcgctgggtgacgacttcgggcacgttctacggccgttcctctggtcggctggggaccgcggccgcgcacgcgcggcggggggcgtggggctgggcccagccggacgcgacctcagcctgcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggttcttgaattagtgttggaaaactttgtttatccgtggtacagggatgtgacagatgatgaatcctttgttgatgaactgagaataacattacgtttttttgcatctgtcttaataagaaggattcacaaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacagaggtagcctaagtttggatgattttcggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaagtga

SEQ ID NO: 369858 - DNA, 4745 bp, Homo sapiens
attgaaactatagtactgtacctacaccatggggtgaatgcatgaaggtcaaatgaaagtgcttagtgtctgtaccgcctaagtaaattttcgcgataatagtcttcctgcatctctcactgtagcggacaatacagaaaaaaaaatttagaaatgtgatgaattagtaaagggaaaaccccatgagactctataagagggattttacctaatctgccaacctgcctcttccaagcactcggattttggttgggctcccggagccggcgtgaattgagctctacccttgcccgtgagcgcgcaaaagagattttgttggtggggtggcggcctgatgagttgtagtctttattctagggctgttttactcgccacccccccagcccccaacacaccccttttaaaataccgactcaaaggcgtcctcctatccccctctcccttaggcgtcacgcaaagctcggacctgctcccacccggagccgagtgtacggtgaggcgcggagcgttgcggggtcggggaagcgctaccacccgctccatccctctgcgggttcgtgtcacgaagactacagttcccagcgggctccacgagctccggttgcccctcaggcagcgcccggcggctacgggggtgctgtagtttcttccgggctccctacaaccttcttccctctcctccgcaatacaggcagttactgggtgctggggctgtcctttgatttccggaaatggccggtcgccagtgttgtcagagtttccacggaagactgcgcgctactccggccaggagggcggagcggcgagacgctagaggctttgcgctgggtgacgacttcgggcacgttctacggccgttcctctggtcggctggggaccgcggccgcgcacgcgcggcggggggcgtggggctgggcccagccggacgcgacctcagcctgcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggttcttgaattagtgttggaaaactttgtttatccgtggtacagggatgtgacagatgatgaatcctttgttgatgaactgagaataacattacgtttttttgcatctgtcttaataagaaggattcacaaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacagaggtagcctaagtttggatgattttcggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccaggtgtaatatttaagaagtaacttaatttcatatagattagcagtccgttgaggtcacaatgtatagtaattattgaagctaattttttactgtgagttttcattttacaaatagttgcaaagatcagttaaaattaacacactagttaaataattctttcagatgttagcactaagactaagatattaggactttaaggcaaggctgtttctactcacataatagccagattcattcaaaaataacttatagtcagactggtcaaagtgacatgtgggacaattgaaggcctgtgtccacgacaccataagaatagctcactagtgtgtatgataaaagatcagaattcattcattccaaatttattgagcaccttccatattccaggcactatgcaaaatgcaaggcatataaaaaatgcacttgagtaggtcagtctagcaggaagacaggcatatagacaaaacatacatgtgataatagaggcattttcaagttacagagatatcacaaaggaggaggatggtcacctcctctgtaaagttggtaggtttgggccactaaggaaatgagtggtagtaacctcttaactgtgacgggaaataacaaggaagaaatgtcaagggatcaaagcaggtgattcttagtttagaacattttgaatgagaagtgcctataaattactcaggaggaagtgtctgttaaacacttagacaccgaggttcaaaagttggagaaaaggtggtataggatagattagtagagatatgggagccatgtgtgagtagatactaaagcatagggagaaagtatggagtaagaagagaaaagggtgacttccagtttctggtctggcacataagaacctggccatcatcactccatcctagtaacaagcaaaaacctgaatgaactaaaaaaactaaacaactcttagattcaccagagagtgaggtcatacggcaagccactgccccccaaggttggagagaatcatagctagctgcagcagaaacccgt

SEQ ID NO: 369859 - DNA, 3711 bp, Homo sapiens
  misc_feature (3633)..(3633): n is a, c, g, or t
  misc_feature (3640)..(3640): n is a, c, g, or t
attgaaactatagtactgtacctacaccatggggtgaatgcatgaaggtcaaatgaaagtgcttagtgtctgtaccgcctaagtaaattttcgcgataatagtcttcctgcatctctcactgtagcggacaatacagaaaaaaaaatttagaaatgtgatgaattagtaaagggaaaaccccatgagactctataagagggattttacctaatctgccaacctgcctcttccaagcactcggattttggttgggctcccggagccggcgtgaattgagctctacccttgcccgtgagcgcgcaaaagagattttgttggtggggtggcggcctgatgagttgtagtctttattctagggctgttttactcgccacccccccagcccccaacacaccccttttaaaataccgactcaaaggcgtcctcctatccccctctcccttaggcgtcacgcaaagctcggacctgctcccacccggagccgagtgtacggtgaggcgcggagcgttgcggggtcggggaagcgctaccacccgctccatccctctgcgggttcgtgtcacgaagactacagttcccagcgggctccacgagctccggttgcccctcaggcagcgcccggcggctacgggggtgctgtagtttcttccgggctccctacaaccttcttccctctcctccgcaatacaggcagttactgggtgctggggctgtcctttgatttccggaaatggccggtcgccagtgttgtcagagtttccacggaagactgcgcgctactccggccaggagggcggagcggcgagacgctagaggctttgcgctgggtgacgacttcgggcacgttctacggccgttcctctggtcggctggggaccgcggccgcgcacgcgcggcggggggcgtggggctgggcccagccggacgcgacctcagcctgcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggttcttgaattagtgttggaaaactttgtttatccgtggtacagggatgtgacagatgatgaatcctttgttgatgaactgagaataacattacgtttttttgcatctgtcttaataagaaggattcacaaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacagaggtagcctaagtttggatgattttcggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagaggacntctcaanatgctttttctgggaaacactgacctcttttccaaaaacgcaaggggcaaacaactttgagaatgggattc

SEQ ID NO: 369860 - DNA, 3529 bp, Homo sapiens
attgaaactatagtactgtacctacaccatggggtgaatgcatgaaggtcaaatgaaagtgcttagtgtctgtaccgcctaagtaaattttcgcgataatagtcttcctgcatctctcactgtagcggacaatacagaaaaaaaaatttagaaatgtgatgaattagtaaagggaaaaccccatgagactctataagagggattttacctaatctgccaacctgcctcttccaagcactcggattttggttgggctcccggagccggcgtgaattgagctctacccttgcccgtgagcgcgcaaaagagattttgttggtggggtggcggcctgatgagttgtagtctttattctagggctgttttactcgccacccccccagcccccaacacaccccttttaaaataccgactcaaaggcgtcctcctatccccctctcccttaggcgtcacgcaaagctcggacctgctcccacccggagccgagtgtacggtgaggcgcggagcgttgcggggtcggggaagcgctaccacccgctccatccctctgcgggttcgtgtcacgaagactacagttcccagcgggctccacgagctccggttgcccctcaggcagcgcccggcggctacgggggtgctgtagtttcttccgggctccctacaaccttcttccctctcctccgcaatacaggcagttactgggtgctggggctgtcctttgatttccggaaatggccggtcgccagtgttgtcagagtttccacggaagactgcgcgctactccggccaggagggcggagcggcgagacgctagaggctttgcgctgggtgacgacttcgggcacgttctacggccgttcctctggtcggctggggaccgcggccgcgcacgcgcggcggggggcgtggggctgggcccagccggacgcgacctcagcctgcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggttcttgaattagtgttggaaaactttgtttatccgtggtacagggatgtgacagatgatgaatcctttgttgatgaactgagaataacattacgtttttttgcatctgtcttaataagaaggattcacaaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacagaggtagcctaagtttggatgattttcggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaaggtactgcacattgcattaaagaactattaagttttaagttgccctacttgagattactttttcattgtcgagagaatgaatactttgttaatgaaatggattgagctatacatttcctttatgtggaaatcagttgaacggtatacagagggtattgtgtgtaattacttggttctttgctttaatgtg

SEQ ID NO: 369861 - DNA, 2545 bp, Homo sapiens
attgaaactatagtactgtacctacaccatggggtgaatgcatgaaggtcaaatgaaagtgcttagtgtctgtaccgcctaagtaaattttcgcgataatagtcttcctgcatctctcactgtagcggacaatacagaaaaaaaaatttagaaatgtgatgaattagtaaagggaaaaccccatgagactctataagagggattttacctaatctgccaacctgcctcttccaagcactcggattttggttgggctcccggagccggcgtgaattgagctctacccttgcccgtgagcgcgcaaaagagattttgttggtggggtggcggcctgatgagttgtagtctttattctagggctgttttactcgccacccccccagcccccaacacaccccttttaaaataccgactcaaaggcgtcctcctatccccctctcccttaggcgtcacgcaaagctcggacctgctcccacccggagccgagtgtacggtgaggcgcggagcgttgcggggtcggggaagcgctaccacccgctccatccctctgcgggttcgtgtcacgaagactacagttcccagcgggctccacgagctccggttgcccctcaggcagcgcccggcggctacgggggtgctgtagtttcttccgggctccctacaaccttcttccctctcctccgcaatacaggcagttactgggtgctggggctgtcctttgatttccggaaatggccggtcgccagtgttgtcagagtttccacggaagactgcgcgctactccggccaggagggcggagcggcgagacgctagaggctttgcgctgggtgacgacttcgggcacgttctacggccgttcctctggtcggctggggaccgcggccgcgcacgcgcggcggggggcgtggggctgggcccagccggacgcgacctcagcctgcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggttcttgaattagtgttggaaaactttgtttatccgtggtacagggatgtgacagatgatgaatcctttgttgatgaactgagaataacattacgtttttttgcatctgtcttaataagaaggattcacaaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtgggtgaggcttacctgtgtattttacgaaagtaatttttaaaccttttaatgtatttgaatattttaaatcagatctgattttttttttgtttgaggcggaatttcactctcgttgcccaggctggagtgcaatggtgtgatcttggctcactgcaacctccgcctcctgggttcaagcgattctcctgcctcagtctcccaagtagctgggattacaggcatgtgccagcaccccagctaattttgtatttttagtagagatggggtttctccatgttggtcaggctggtcttgaattcccgacctcaggtgatccacccacctcggcctcccaaagtgctggggttacaggcgtgagccaccgcg

SEQ ID NO: 369862 - DNA, 3835 bp, Homo sapiens
tttgtagtggctgaaggtctgacatgtttgatcaaggtgggagctgaggctgatcagaactatcagaactacatcttaagggctttgggccagattatgttgtatgtggatggaatgaatggagtaataaaccgcaatgaaaccattcagtggctgtacactctcattgggtcaaagttccgcctggtggtgaagacagccctgaagctgctgctcgtctttgtagagtactcggagtccaacgcacctctcctaattcaggctgtcactgctgttgacacgaaaagaggggtcaaaccttggtcaaatatcatggaaatcctggaggaaaaagatggagttgatacggagctactggtttatgcaatgactttggtgaacaagacgttatcaggactaccagaccaagacaccttctacgacgtcgtggactgcctggaggagctgggcattgctgctgtgtcccagaggcacttgaacaagaaagggactgacctggacttagtggagcaactcaacatttatgaggtggcgctcaggcacgaggatggcgatgagaccacggagccaccccccagtgggtgccgggaccggaggagggccagcgtgtgttccagtggcggaggcgagcaccggggcctggaccgcagaaggagccgcaggcactcggtgcagagcatcaagagcaccctgtcggcccccaccagtccctgctcccagtcagctcccagcttcaagcccaaccaagtgcgagatctgcgtgaaaagtcatcaccgagtggtcttctcacatcatccttcaggcagcaccaagagtcactggcagcagagagagagaggcggcggcaggagagagaagaaaggttgcagagaatagagcgggaagaaagaaacaaattcagccgagattatttagacaaaagagaggagcaaaggcaagcaagagaagaaagatacaaatacttggaacagttggcagctgaggagcacgagaaggagctgagaagccggagtgtgagccggggcagagccgacctctccttggacctgacctcgccagcagccccagcctgcctggctcctctgagccatagcccctcatcttcagactctcaagaggctctcacggtgtctgcctcctccccaggaacccctcaccatccccaagcaagtgccggggatcctgaacccgaatcagaggcagaaccggaagcagaggcaggggcggggcaggttgctgatgaagctggccaggacatagcctctgcccacgagggtgcagagactgaagtggagcaggcactagagcaagagccggaagaaagagcctccctcagtgaaaaagagaggcagaacgagggggtgaacgagagggacaactgctctgcctccagcgtctcgtcctccagcagcacgttggagagggaggagaaggaggacaagctctccagggacaggacaactggtttgtggcccgcaggtgtccaggatgcaggtgtaaatggacagtgtggcgacatcctcaccaacaaacggttcatgcttgacatgctgtatgcccataacaggaagtctccggatgatgaggagaagggggatggggaggctgggaggacccagcaggaggcagaggcggtagccagccttgctaccaggatatccaccctgcaggccaactctcagacccaggatgagagtgtcaggagggtggatgtcggctgtttggacaatcggggcagtgtgaaagcatttgctgagaaattcaacagtggggacctggggagaggttccatctcccctgatgctgagcccaatgacaaggtcccagaaacagcgccggtgcagccgaagacagagtctgattacatctgggaccagctcatggccaatccaagagagctcagaatccaagacatggatttcactgacctgggggaggaggatgacattgatgtcctagatgtggacctgggtcacagggaggcccctgggccacctcccccacccccacccacctttctgggtttgccgcccccaccccctccgcccctgttggacagcattcctccccctcctgtccctggtaatttattggttcctcctcctccagtgttcaacgctcctcagggcttagggtggtcccaggtacccaggggtcagcccacattcactaagaaaaagaagaccatccgtttgttctggaatgaagttcggccttttgactggccatgtaaaaacaaccgacgctgcagagaattcctgtggtcaaaactggaacccattaaggtggacacttccagactggagcacctgtttgagtctaaatccaaggaactgtctgtctcaaagaaaactgctgcagatggaaaaaggcaagagatcattgttctggattccaagaggagtaacgccatcaatattggtctgacggtgctgccccctccaaggacgattaagatcgccattttgaattttgatgagtatgccttaaacaaagaaggaatcgagaaaattctaacgatgattcccaccgatgaggagaagcagaaaatccaggaagctcagctggccaaccctgaaatccccctgggcagtgcagagcagttcctcctcaccctgtcctccatcagcgagctctctgcacgacttcacctctgggcattcaaaatggattatgaaactacagaaaaggaagtagcagaaccactcctggacctgaaggaaggaatagaccagttggagaacaataaaaccttgggctttatcctgtctactctcttagccattgggaactttctaaatggaactaatgccaaagcgtttgagttaagctacctcgagaaggttccagaagtcaaagacacagtgcacaagcagtcgcttctccaccatgtgtgcaccatggtggtagaaaacttcccagacagctccgatctgtactcggagatcggggccatcaccaggtcagccaaggttgactttgatcaacttcaggataatttatgtcagatggagagaagatgcaaagcttcatgggatcacctcaaggcaattgcaaaacatgaaatgaaaccagttttaaaacaacggatgtcagagttcctgaaagactgtgcagagcgaattataattttaaagattgtccatagaaggataatcaacagattccactcctttttactctttatgggccatccaccttatgcaattcgggaagtgaacataaacaaattctgcaggattattagtgaatttgcactagagtatcgcacaaccagggaaagggttttgcagcagaaacagaaacgggccaaccacagagagagaaataagaccagagggaagatgatcaccgattctggcaagttctccggcagttctccggcgcccccaagccagccgcagggtctgagctatgcggaggacgcggctgagcacgagaacatgaaggctgtgctgaaaacctcgtccccctccaggagtcccctgcacataccttctccatcgtgtcagctgtgtttctcttgattccgtgacacccggtttattagttcaaaagtgtgacaccttttctgggcaaggaacagcccctttaaggagcaaatcacttctgtcacagttattatggtaatatgaggcaatctgattagcttcacagactgagtctccacaacaccaaaatatccagatgtaaaccccaaacttgtacacaaaagaaagcacagattgtttacctgttgtggattttagatgtaacaaatgtttatacaaatacatacatgtacaccatgtttcaaatactaaataaatagagtttaatgccaaaaaaaaaaac

SEQ ID NO: 369863 - DNA, 1069 bp, Homo sapiens
tttgtagtggctgaaggtctgacatgtttgatcaaggtgggagctgaggctgatcagaactatcagaactacatcttaagggctttgggccagattatgttgtatgtggatggaatgaatggagtaataaaccgcaatgaaaccattcagtggctgtacactctcattgggtcaaagttccgcctggtggtgaagacagccctgaagctgctgctcgtctttgtagagtactcggagtccaacgcacctctcctaattcaggctgtcactgctgttgacacgaaaagaggggtcaaaccttggtcaaatatcatggaaatcctggaggaaaaagatggagttgatacggagctactggtttatgcaatgactttggtgaacaagacgttatcaggactaccagaccaagacaccttctacgacgtcgtggactgcctggaggagctgggcattgctgctgtgtcccagaggcacttgaacaagaaagggactgacctggacttagtggagcaactcaacatttatgaggtaccagaccatgccttttgtaaggtatcgtacagctttggcaattgtcaaaggctgagatggcgcctactttagaccacgcgtaaagcgtatgagcaccaccagcttattagaaactcagcatcgtaggcttcaccccagacctactgaatcagaaactctgagggcccagcagaccatgttatgacaagccttccaggagagtctgatgcatattcaagctcaagaacccttgatataggggaaattggttagctattttcctttaaagaacatgccgtttgtcagcggcaccttcactcaaggagacggggagagaaagagatagagacagaaatcacatttcttatacctgagtggggtggaacttcaggcagggccagatacatgatttgtagcaaccaatgcaaaacgaaaatgaaggaccatttatggaacactcaagcaaaagtgctgttaaagatactgaaacaactcttcactttcttctgtggtttctcccaccttgttatggtgattttctaatttggtatgtaattgt

SEQ ID NO: 369864 - DNA, 4314 bp, Homo sapiens
tttgtagtggctgaaggtctgacatgtttgatcaaggtgggagctgaggctgatcagaactatcagaactacatcttaagggctttgggccagattatgttgtatgtggatggaatgaatggagtaataaaccgcaatgaaaccattcagtggctgtacactctcattgggtcaaagttccgcctggtggtgaagacagccctgaagctgctgctcgtctttgtagagtactcggagtccaacgcacctctcctaattcaggctgtcactgctgttgacacgaaaagaggggtcaaaccttggtcaaatatcatggaaatcctggaggaaaaagatggagttgatacggagctactggtttatgcaatgactttggtgaacaagacgttatcaggactaccagaccaagacaccttctacgacgtcgtggactgcctggaggagctgggcattgctgctgtgtcccagaggcacttgaacaagaaagggactgacctggacttagtggagcaactcaacatttatgaggtggcgctcaggcacgaggatggcgatgagaccacggagccaccccccagtgggtgccgggaccggaggagggccagcgtgtgttccagtggcggaggcgagcaccggggcctggaccgcagaaggagccgcaggcactcggtgcagagcatcaagagcaccctgtcggcccccaccagtccctgctcccagtcagctcccagcttcaagcccaaccaagtgcgagatctgcgtgaaaagtcatcaccgagtggtcttctcacatcatccttcaggcagcaccaagagtcactggcagcagagagagagaggcggcggcaggagagagaagaaaggttgcagagaatagagcgggaagaaagaaacaaattcagccgagattatttagacaaaagagaggagcaaaggcaagcaagagaagaaagatacaaatacttggaacagttggcagctgaggagcacgagaaggagctgagaagccggagtgtgagccggggcagagccgacctctccttggacctgacctcgccagcagccccagcctgcctggctcctctgagccatagcccctcatcttcagactctcaagaggctctcacggtgtctgcctcctccccaggaacccctcaccatccccaagcaagtgccggggatcctgaacccgaatcagaggcagaaccggaagcagaggcaggggcggggcaggttgctgatgaagctggccaggacatagcctctgcccacgagggtgcagagactgaagtggagcaggcactagagcaagagccggaagaaagagcctccctcagtgaaaaagagaggcagaacgagggggtgaacgagagggacaactgctctgcctccagcgtctcgtcctccagcagcacgttggagagggaggagaaggaggacaagctctccagggacaggacaactggtttgtggcccgcaggtgtccaggatgcaggtgtaaatggacagtgtggcgacatcctcaccaacaaacggttcatgcttgacatgctgtatgcccataacaggaagtctccggatgatgaggagaagggggatggggaggctgggaggacccagcaggaggcagaggcggtagccagccttgctaccaggatatccaccctgcaggccaactctcagacccaggatgagagtgtcaggagggtggatgtcggctgtttggacaatcggggcagtgtgaaagcatttgctgagaaattcaacagtggggacctggggagaggttccatctcccctgatgctgagcccaatgacaaggtcccagaaacagcgccggtgcagccgaagacagagtctgattacatctgggaccagctcatggccaatccaagagagctcagaatccaagacatggatttcactgacctgggggaggaggatgacattgatgtcctagatgtggacctgggtcacagggaggcccctgggccacctcccccacccccacccacctttctgggtttgccgcccccaccccctccgcccctgttggacagcattcctccccctcctgtccctggtaatttattggttcctcctcctccagtgttcaacgctcctcagggcttagggtggtcccaggtacccaggggtcagcccacattcactaagaaaaagaagaccatccgtttgttctggaatgaagttcggccttttgactggccatgtaaaaacaaccgacgctgcagagaattcctgtggtcaaaactggaacccattaaggtggacacttccagactggagcacctgtttgagtctaaatccaaggaactgtctgtctcaaagaaaactgctgcagatggaaaaaggcaagagatcattgttctggattccaagaggagtaacgccatcaatattggtctgacggtgctgccccctccaaggacgattaagatcgccattttgaattttgatgagtatgccttaaacaaagaaggaatcgagaaaattctaacgatgattcccaccgatgaggagaagcagaaaatccaggaagctcagctggccaaccctgaaatccccctgggcagtgcagagcagttcctcctcaccctgtcctccatcagcgagctctctgcacgacttcacctctgggcattcaaaatggattatgaaactacagaaaaggaagtagcagaaccactcctggacctgaaggaaggaatagaccagttggagaacaataaaaccttgggctttatcctgtctactctcttagccattgggaactttctaaatggaactaatgccaaagcgtttgagttaagctacctcgagaaggttccagaagtcaaagacacagtgcacaagcagtcgcttctccaccatgtgtgcaccatggtggtagaaaacttcccagacagctccgatctgtactcggagatcggggccatcaccaggtcagccaaggttgactttgatcaacttcaggataatttatgtcagatggagagaagatgcaaagcttcatgggatcacctcaaggcaattgcaaaacatgaaatgaaaccagttttaaaacaacggatgtcagagttcctgaaagactgtgcagagcgaattataattttaaagattgtccatagaaggataatcaacagattccactcctttttactctttatgggccatccaccttatgcaattcgggaagtgaacataaacaaattctgcaggattattagtgaatttgcactagagtatcgcacaaccagggaaagggttttgcagcagaaacagaaacgggccaaccacagagagagaaataagaccagagggaagatgatcaccgattctggcaagttctccggcagttctccggcgcccccaagccagccgcagggtctgagctatgcggaggacgcggctgagcacgagaacatgaaggctgtgctgaaaacctcgtccccctccgtggaggacgccacccccgcgctgggcgtccgcacacgcagccgagcaagccgaggatccactagttcctggactatgggaactgatgactcgcccaatgtcacagatgatgcagctgatgagatcatggaccgcatcgtcaagtcagccacccaagtgcccagtcagcgagtggtgccgagggagaggaaacgatcccgggccaaccggaaatctttgcgaagaaccctgaagagcggcctgaccccagaagaagccagagccctgggcttggttggcacctcggagttgcagctgtgacactcataggttactcccaggagtgtgctgagcagaaggcaagctcttgctggatgaaacccctccaggtggggttggggagacttgatattcacatccaacagtttgaaaagggagagctcaattcccagcgtcaccccatggcttgtgttgcctgctacgcattgacttggatctccaggagtcccctgcacataccttctccatcgtgtcagctgtgtttctcttgattccgtgacacccggtttattagttcaaaagtgtgacaccttttctgggcaaggaacagcccctttaaggagcaaatcacttctgtcacagttattatggtaatatgaggcaatctgattagcttcacagactgagtctccacaacaccaaaatatccagatgtaaaccccaaacttgtacacaaaagaaagcacagattgtttacctgttgtggattttagatgtaacaaatgtttatacaaatacatacatgtacaccatgtttcaaatactaaataaatagagtttaatgccaaaaaaaaaaac

SEQ ID NO: 369865 - DNA, 1692 bp, Homo sapiens
gtttactagaggatccccattcgcgaatcacgtctggcattcaaaatggattatgatactacagaaaaggaagtagcagaaccactcctggacctgaaggaaggaatagaccagttggagaacaataaaaccttgggctttatcctgtctactctcttagccattgggaactttctaaatggaactaatgccaaagcgtttgagttaagctacctcgagaaggttccagaagtcaaagacacagtgcacaagcagtcgcttctccaccatgtgtgcaccatggtggtagaaaacttcccagacagctccgatctgtactcggagatcggggccatcaccaggtcagccaaggttgactttgatcaacttcaggataatttatgtcagatggagagaagatgcaaagcttcatgggatcacctcaaggcaattgcaaaacatgaaatgaaaccagttttaaaacaacggatgtcagagttcctgaaagactgtgcagagcgaattataattttaaagattgtccatagaaggataatcaacagattccactcctttttactctttatgggccatccaccttatgcaattcgggaagtgaacataaacaaattctgcaggattattagtgaatttgcactagagtatcgcacaaccagggaaagggttttgcagcagaaacagaaacgggccaaccacagagagagaaataagaccagagggaagatgatcaccgattctggcaagttctccggcagttctccggcgcccccaagccagccgcagggtctgagctatgcggaggacgcggctgagcacgagaacatgaaggctgtgctgaaaacctcgtccccctccgtggaggacgccacccccgcgctgggcgtccgcacacgcagccgagcaagccgaggatccactagttcctggactatgggaactgatgactcgcccaatgtcacagatgatgcagctgatgagatcatggaccgcatcgtcaagtcagccacccaagtgcccagtcagcgagtggtgccgagggagaggaaacgatcccgggccaaccggaaatctttgcgaagaaccctgaagagcggcctgaccccagaagaagccagagccctgggcttggttggcacctcggagttgcagctgtgacactcataggttactcccaggagtgtgctgagcagaaggcaagctcttgctggatgaaacccctccaggtggggttggggagacttgatattcacatccaacagtttgaaaagggagagctcaattcccagcgtcaccccatggcttgtgttgcctgctacgcattgacttggatctccaggagtcccctgcacataccttctccatcgtgtcagctgtgtttctcttgattccgtgacacccggtttattagttcaaaagtgtgacaccttttctgggcaaggaacagcccctttaaggagcaaatcacttctgtcacagttattatggtaatatgaggcaatctgattagcttcacagactgagtctccacaacaccaaaatatccagatgtaaaccccaaacttgtacacaaaagaaagcacagattgtttacctgttgtggattttagatgtaacaaatgtttatacaaatacatacatgtacaccatgtttcaaatactaaataaatagagtttaatgccaaaaaaaaaaac

SEQ ID NO: 369866 - DNA, 2732 bp, Homo sapiens
tttgtagtggctgaaggtctgacatgtttgatcaaggtgggagctgaggctgatcagaactatcagaactacatcttaagggctttgggccagattatgttgtatgtggatggaatgaatggagtaataaaccgcaatgaaaccattcagtggctgtacactctcattgggtcaaagttccgcctggtggtgaagacagccctgaagctgctgctcgtctttgtagagtactcggagtccaacgcacctctcctaattcaggctgtcactgctgttgacacgaaaagaggggtcaaaccttggtcaaatatcatggaaatcctggaggaaaaagatggagttgatacggagctactggtttatgcaatgactttggtgaacaagacgttatcaggactaccagaccaagacaccttctacgacgtcgtggactgcctggaggagctgggcattgctgctgtgtcccagaggcacttgaacaagaaagggactgacctggacttagtggagcaactcaacatttatgaggtggcgctcaggcacgaggatggcgatgagaccacggagccaccccccagtgggtgccgggaccggaggagggccagcgtgtgttccagtggcggaggcgagcaccggggcctggaccgcagaaggagccgcaggcactcggtgcagagcatcaagagcaccctgtcggcccccaccagtccctgctcccagtcagctcccagcttcaagcccaaccaagtgcgagatctgcgtgaaaagtcatcaccgagtggtcttctcacatcatccttcaggcagcaccaagagtcactggcagcagagagagagaggcggcggcaggagagagaagaaaggttgcagagaatagagcgggaagaaagaaacaaattcagccgagattatttagacaaaagagaggagcaaaggcaagcaagagaagaaagatacaaatacttggaacagttggcagctgaggagcacgagaaggagctgagaagccggagtgtgagccggggcagagccgacctctccttggacctgacctcgccagcagccccagcctgcctggctcctctgagccatagcccctcatcttcagactctcaagaggctctcacggtgtctgcctcctccccaggaacccctcaccatccccaagcaagtgccggggatcctgaacccgaatcagaggcagaaccggaagcagaggcaggggcggggcaggttgctgatgaagctggccaggacatagcctctgcccacgagggtgcagagactgaagtggagcaggcactagagcaagagccggaagaaagagcctccctcagtgaaaaagagaggcagaacgagggggtgaacgagagggacaactgctctgcctccagcgtctcgtcctccagcagcacgttggagagggaggagaaggaggacaagctctccagggacaggacaactggtttgtggcccgcaggtgtccaggatgcaggtgtaaatggacagtgtggcgacatcctcaccaacaaacggttcatgcttgacatgctgtatgcccataacaggaagtctccggatgatgaggagaagggggatggggaggctgggaggacccagcaggaggcagaggcggtagccagccttgctaccaggatatccaccctgcaggccaactctcagacccaggatgagagtgtcaggagggtggatgtcggctgtttggacaatcggggcagtgtgaaagcatttgctgagaaattcaacagtggggacctggggagaggttccatctcccctgatgctgagcccaatgacaaggtcccagaaacagcgccggtgcagccgaagacagagtctgattacatctgggaccagctcatggccaatccaagagagctcagaatccaagacatggatttcactgacctgggggaggaggatgacattgatgtcctagatgtggacctgggtcacagggaggcccctgggccacctcccccacccccacccacctttctgggtttgccgcccccaccccctccgcccctgttggacagcattcctccccctcctgtccctggtaatttattggttcctcctcctccagtgttcaacgctcctcagggcttagggtggtcccagaagaagccagagccctgggcttggttggcacctcggagttgcagctgtgacactcataggttactcccaggagtgtgctgagcagaaggcaagctcttgctggatgaaacccctccaggtggggttggggagacttgatattcacatccaacagtttgaaaagggagagctcaattcccagcgtcaccccatggcttgtgttgcctgctacgcattgacttggatctccaggagtcccctgcacataccttctccatcgtgtcagctgtgtttctcttgattccgtgacacccggtttattagttcaaaagtgtgacaccttttctgggcaaggaacagcccctttaaggagcaaatcacttctgtcacagttattatggtaatatgaggcaatctgattagcttcacagactgagtctccacaacaccaaaatatccagatgtaaaccccaaacttgtacacaaaagaaagcacagattgtttacctgttgtggattttagatgtaacaaatgtttatacaaatacatacatgtacaccatgtttcaaatactaaataaatagagtttaatgccaaaaaaaaaaac

SEQ ID NO: 369867 - DNA, 2105 bp, Homo sapiens
tttgtagtggctgaaggtctgacatgtttgatcaaggtgggagctgaggctgatcagaactatcagaactacatcttaagggctttgggccagattatgttgtatgtggatggaatgaatggagtaataaaccgcaatgaaaccattcagtggctgtacactctcattgggtcaaagttccgcctggtggtgaagacagccctgaagctgctgctcgtctttgtagagtactcggagtccaacgcacctctcctaattcaggctgtcactgctgttgacacgaaaagaggggtcaaaccttggtcaaatatcatggaaatcctggaggaaaaagatggagttgatacggagctactggtttatgcaatgactttggtgaacaagacgttatcaggactaccagaccaagacaccttctacgacgtcgtggactgcctggaggagctgggcattgctgctgtgtcccagaggcacttgaacaagaaagggactgacctggacttagtggagcaactcaacatttatgaggtggcgctcaggcacgaggatggcgatgagaccacggagccaccccccagtgggtgccgggaccggaggagggccagcgtgtgttccagtggcggaggcgagcaccggggcctggaccgcagaaggagccgcaggcactcggtgcagagcatcaagagcaccctgtcggcccccaccagtccctgctcccagtcagctcccagcttcaagcccaaccaagtgcgagatctgcgtgaaaagtcatcaccgagtggtcttctcacatcatccttcaggcagcaccaagagtcactggcagcagagagagagaggcggcggcaggagagagaagaaaggttgcagagaatagagcgggaagaaagaaacaaattcagccgagattatttagacaaaagagaggagcaaaggcaagcaagagaagaaagatacaaatacttggaacagttggcagctgaggagcacgagaaggagctgagaagccggagtgtgagccggggcagagccgacctctccttggacctgacctcgccagcagccccagcctgcctggctcctctgagccatagcccctcatcttcagactctcaagaggctctcacggtgtctgcctcctccccaggaacccctcaccatccccaagcaagtgccggggatcctgaacccgaatcagaggcagaaccggaagcagaggcaggggcggggcaggttgctgatgaagctggccaggacatagcctctgcccacgagggtgcagagactgaagtggagcaggcactagagcaagagccggaagaaagagcctccctcagtgaaaaagagaggcagaacgagggggtgaacgagagggacaactgctctgcctccagcgtctcgtcctccagcagcacgttggagagggaggagaaggaggacaagctctccagggacaggacaactggtaaatgaagccccttgtttcagtcggcatgtgccagggaggcctggggtgcaggggctggttctctaagagcttgtccacaggctggcctctgaggtgacctgggtcaacccactcatgtggctgtgtcacccagtgtctggggacaaggagtgtggccacgctggcagccagccagcagccttctgccctgtagaaagacagcccccaaactgtctgccacaccatcacattcatcacctccacacctggggaaaagggccccgataaggagggcttttcctgaggaataagccccagaagagaaacctctcacttccccctgactgttccattgtgaataatagtaaggttgataatagtaaggctttttccgtttttgatataagtttagaaactgtcacattgtcatctattcctttaaaaatgtgtttactgaagtgtgttaatcattttgactggacatttcagactgggaaagatttgtttaaatggattgaatgagtatttccaaaaaattgtacacagtttactgaggtcaatttgatgtactggaatatagataatttgttttctatattacactcataactattcttttctttgtataaagtatatgcttttccttatggaagtatat

SEQ ID NO: 369868 - DNA, 2671 bp, Homo sapiens
ggaagggaaaaagggggactgcagtatgcgtcacacccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaatgtgttaaatatgggcccatttatacttatggggaagggtgtgagactatacacaaggatgagtttggagatgtctgaagtattcccaggttgaggaggagagaggggaaatagcaccattggttcctttccgtgagtatgtgcggggagaagtttcaagaaggttcttatggaaaaaaggctgtgagcatagaaagcagtcataggaggttggggaactagcttgtccctccccacccccagatcctgcaaaagaggtacaaagcttcccagagggccacagggcccagaccagagtcaagcctcttgttttaggagaaacctcagtggacaggcagggtagcccagtccttagatctgtggggaaggccctgagcccttctggagctaggagtggcaagagtgggagtcaagtatttgaccagcagagcctctatgtaggaatcatggtcactttaccaatactgatggggagggcctgttccccattgcaggcctagaatggtttgaatgggagaagtcaggaagtactgtagtagctgtaggggagagaagattctgagagccagaaggcaggaatggatttggttttgagcagggacgtggaaacgtggagaccaggtgaggtctcattattttggggcgaaaatgtgggttgctattaatactcctgcaatgggcgtgtgaatgtgttcccagaaatgagtggggaattccacccccaaaaagcagctgcagggccagtggccgggccaaacttctagttggagacgagactcagctttccgctggtacaatgcggagcggagcacgagggtcgcaggtgcagaacagcgggaagatgcgctcccccagggggccaggcgcctggaaggcgtaaagcaggtcgagtgagcggccgtcgtagaaggccacgcggccccgctcccagtccaggtccacgcgaatgcgccgcggcgggggctcaacaccgcccagcagggtgggttcgggtgccgtgagggcccacaggcggccgccg

SEQ ID NO: 369869 - DNA, 2284 bp, Homo sapiens
ggaagggaaaaagggggactgcagtatgcgtcacacccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaaaaaaaaaaacaaaacaaaaaaaacaaaaaaacaaaaaaaaaaaaaaaaaaaaaaaaaaaaaaaaaaaaaaaaaaaaaaaaagagagagggggggggcggcaaatccccgggggggccagacacaagaacgagccacacacccatttgttgagtcaaaaaaaggggccacacgaaaaagaggggcagaggataaaaaagaagaagaacagcggatgacgcgggagggtaaaaaaacagcagccgctgtgcgataaagaacaaggaagaggcagcagagaacgaacgtagtagaacaaggacaacagccaactctggcaggtgggggggggcgaagcacacaccctgggcggcggaggcaaaaacccactcccacgcgaagagagaaataacaagacgcccgcacgagagaggagagcaaacaaacctaccaccgctcgcggagggagacagagcgtgatagacggaggcggcgtaacacaccacgccgaggcgcactgcatcaagaagcgcgcgacaggcggaggagagaaaaaggaggaacagcccacagaggcaaaagagtcaccgcagcagaagaccaaaagtctacagccaacgcgggagccggcggctgcgagcacccaaacccgaaggc

SEQ ID NO: 369870 - DNA, 2885 bp, Homo sapiens
aggagcgagtaaatgatgtatgagtgcgatacgcggttgtaatttcagtcacgaggcaggcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaatgtgttaaatatgggcccatttatacttatggggaagggtgtgagactatacacaaggatgagtttggagatgtctgaagtattcccaggttgaggaggagagaggggaaatagcaccattggttcctttccgtgagtatgtgcggggagaagtttcaagaaggttcttatggaaaaaaggctgtgagcatagaaagcagtcataggaggttggggaactagcttgtccctccccacccccagatcctgcaaaagaggtacaaagcttcccagagggccacagggcccagaccagagtcaagcctcttgttttaggagaaacctcagtggacaggcagggtagcccagtccttagatctgtggggaaggccctgagcccttctggagctaggagtggcaagagtgggagtcaagtatttgaccagcagagcctctatgtaggaatcatggtcactttaccaatactgatggggagggcctgttccccattgcaggcctagaatggtttgaatgggagaagtcaggaagtactgtagtagctgtaggggagagaagattctgagagccagaaggcaggaatggatttggttttgagcagggacgtggaaacgtggagaccaggtgaggtctcattattttggggcgaaaatgtgggttgctattaatactcctgcaatgggcgtgtgaatgtgttcccagaaatgagtggggaattccacccccaaaaagcactcgcggctgattcgcacctccaccgccagccgcacattagacctcaggctgcggcggggacacggcaggccgcagcagggacaggcggtgggggaagcctcggtgccggtcgccggcggagtcccccagcggcgggccagacacgcgcggcagaagctgtgctcgcacgccagaagcaccgggtcctcgaaggagcccccgcacagaggacacgtcgccagctgctccagacgctccaccagccccgggcccagctcgggcgcatccatggaaagccaggatctggacgccgccccttccgcgaccaccgtgaccgccttcgagcgcgcagatggcgggccgcccctgctgcttgctgtgtagatgcccttctctccgactcccgcattaacttttgccgctttccgcccctctcctgggattgcctctctcttcaaccagagtctcagtctcgtcaaatctctccaccacatcaggctttatagggagggaggaggctcccacgggaggtaaacaccaggccttgcgtaacgcc

SEQ ID NO: 369871 - DNA, 2992 bp, Homo sapiens
ggaagggaaaaagggggactgcagtatgcgtcacacccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaatgtgttaaatatgggcccatttatacttatggggaagggtgtgagactatacacaaggatgagtttggagatgtctgaagtattcccaggttgaggaggagagaggggaaatagcaccattggttcctttccgtgagtatgtgcggggagaagtttcaagaaggttcttatggaaaaaaggctgtgagcatagaaagcagtcataggaggttggggaactagcttgtccctccccacccccagatcctgcaaaagaggtacaaagcttcccagagggccacagggcccagaccagagtcaagcctcttgttttaggagaaacctcagtggacaggcagggtagcccagtccttagatctgtggggaaggccctgagcccttctggagctaggagtggcaagagtgggagtcaagtatttgaccagcagagcctctatgtaggaatcatggtcactttaccaatactgatggggagggcctgttccccattgcaggcctagaatggtttgaatgggagaagtcaggaagtactgtagtagctgtaggggagagaagattctgagagccagaaggcaggaatggatttggttttgagcagggacgtggaaacgtggagaccaggtgaggtctcattattttggggcgaaaatgtgggttgctattaatactcctgcaatgggcgtgtgaatgtgttcccagaaatgagtggggaattccacccccaaaaagcactcgcggctgattcgcacctccaccgccagccgcacattagacctcaggctgcggcggggacacggcaggccgcagcagggacaggcggtgggggaagcctcggtgccggtcgccggcggagtcccccagcggcgggccagacacgcgcggcagaagctgtgctcgcacgccagaagcaccgggtcctcgaaggagcccccgcacagaggacacgtcgccagctgctccagacgctccaccagccccgggcccagctcgggcgcatccatggaaagccaggatctggacgccgccccttccgcgaccaccgtgaccgccttcgagcgcgcagatggcgggccgcccctgctgcttgctgtgtagatgcccttctctccgactcccgcattaacttttgccgctttccgcccctctcctgggattgcctctctcttcaaccagagtctcagtctcgtcaaatctctccaccacatcaggctttatagggagggaggaggctcccacgggaggtaaacaccaggccttgcgtaacgcc

SEQ ID NO: 369872 - DNA, 3419 bp, Homo sapiens
ggaagatgttgggaggaaatcaaaggtagtgtaagaaagcatggttggaggccaacttatcaatattatcaatattgatattcgaataaatatttattgaatggatgaatgtaaaaggaagtggcaggaatgaggaaacaagaaaaggagatgaaaagaggtattttgagaaatcagagagcaaagatgtaaatggagaaacaagaagtatttatccaaaaacatgttaagttgccttcaaagggagaaggttgcattgggcttaatactcttggattaaaggaagtttagtaattaatagattagtaatacttgctactagagatgccaggatgccagagaataggtggataagaggtagggagggctggagcttgagaatgagagaggttttgtttgtttttttaagagaaaaagaataggggatctggaaaaaggaagggagatcaaagattaggtgctggggactgaaaaataattttcatgtattaatactaccaaggatgatttggggaggaagacggagaaacagcaaggattatattttcctttgaagagttgctgggacctttcctaggttaggaattgtgtcttctcttatactggtggtataagaacaggaaataatacttattcctcaagggactatctgaggtaaaagacctgttctgttttatcttctgtcagctcctctggtgctatgcctatggtactgattgagctaaagaagaaaagagaggaggttccctgggagggagtgggaaaggttagtaagaggggactagataggtatgctcatccttaaccttctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaatgtgttaaatatgggcccatttatacttatggggaagggtgtgagactatacacaaggatgagtttggagatgtctgaagtattcccaggttgaggaggagagaggggaaatagcaccattggttcctttccgtgagtatgtgcggggagaagtttcaagaaggttcttatggaaaaaaggctgtgagcatagaaagcagtcataggaggttggggaactagcttgtccctccccacccccagatcctgcaaaagaggtacaaagcttcccagagggccacagggcccagaccagagtcaagcctcttgttttaggagaaacctcagtggacaggcagggtagcccagtccttagatctgtggggaaggccctgagcccttctggagctaggagtggcaagagtgggagtcaagtatttgaccagcagagcctctatgtaggaatcatggtcactttaccaatactgatggggagggcctgttccccattgcaggcctagaatggtttgaatgggagaagtcaggaagtactgtagtagctgtaggggagagaagattctgagagccagaaggcaggaatggatttggttttgagcagggacgtggaaacgtggagaccaggtgaggtctcattattttggggcgaaaatgtgggttgctattaatactcctgcaatgggcgtgtgaatgtgttcccagaaatgagtggggaattccacccccaaaaagcactcgcggctgattcgcacctccaccgccagccgcacattagacctcaggctgcggcggggacacggcaggccgcagcagggacaggcggtgggggaagcctcggtgccggtcgccggcggagtcccccagcggcgggccagacacgcgcggcagaagctgtgctcgcacgccagaagcaccgggtcctcgaaggagcccccgcacagaggacacgtcgccagctgctccagacgctccaccagccccgggcccagctcgggcgcatccatggaaagccaggatctggacgccgccccttccgcgaccaccgtgaccgccttcgagcgcgcagatggcgggccgcccctgctgcttgctgtgtagatgcccttctctccgactcccgcattaacttttgccgctttccgcccctctcctgggattgcctctctcttcaaccagagtctcagtctcgtcaaatctctccaccacatcaggctttatagggagggaggaggctcccacgggaggtaaacaccaggccttgcgtaacgcc

SEQ ID NO: 369873 - DNA, 2763 bp, Homo sapiens
aggagcgagtaaatgatgtatgagtgcgatacgcggttgtaatttcagtcacgaggcaggcggaggcccaggaggagggggaataaagaaggtggaggatcctggctaccactctgaatccgataccgcttctcttagacctcagcgacagaaaaaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaatgtgttaaatatgggcccatttatacttatggggaagggtgtgagactatacacaaggatgagtttggagatgtctgaagtattcccaggttgaggaggagagaggggaaatagcaccattggttcctttccgtgagtatgtgcggggagaagtttcaagaaggttcttatggaaaaaaggctgtgagcatagaaagcagtcataggaggttggggaactagcttgtccctccccacccccagatcctgcaaaagaggtacaaagcttcccagagggccacagggcccagaccagagtcaagcctcttgttttaggagaaacctcagtggacaggcagggtagcccagtccttagatctgtggggaaggccctgagcccttctggagctaggagtggcaagagtgggagtcaagtatttgaccagcagagcctctatgtaggaatcatggtcactttaccaatactgatggggagggcctgttccccattgcaggcctagaatggtttgaatgggagaagtcaggaagtactgtagtagctgtaggggagagaagattctgagagccagaaggcaggaatggatttggttttgagcagggacgtggaaacgtggagaccaggtgaggtctcattattttggggcgaaaatgtgggttgctattaatactcctgcaatgggcgtgtgaatgtgttcccagaaatgagtggggaattccacccccaaaaagcactcgcggctgattcgcacctccaccgccagccgcacattagacctcaggctgcggcggggacacggcaggccgcagcagggacaggcggtgggggaagcctcggtgccggtcgccggcggagtcccccagcggcgggccagacacgcgcggcagaagctgtgctcgcacgccagaagcaccgggtcctcgaaggagcccccgcacagaggacacgtcgccagctgctccagacgctccaccagccccgggcccagctcgggcgcatccatggaaagccaggatctggacgccgccccttccgcgaccaccgtgaccgccttcgagcgcgcagatggcgggccgcccctgctgcttgctgtgtagatgcccttctctccgactcccgcattaacttttgccgctttccgcccctctcctgggattgcctctctcttcaaccagagtctcagtctcgtcaaatctctccaccacatcaggctttatagggagggaggaggctcccacgggaggtaaacaccaggccttgcgtaacgcc

SEQ ID NO: 369874 - DNA, 2724 bp, Homo sapiens
ggaagggaaaaagggggactgcagtatgcgtcacacccggaagcggcgagccggaagtggggttagccaggttatccccaggggtggagaagcggaggcccaggaggagggggaataagagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaatgtgttaaatatgggcccatttatacttatggggaagggtgtgagactatacacaaggatgagtttggagatgtctgaagtattcccaggttgaggaggagagaggggaaatagcaccattggttcctttccgtgagtatgtgcggggagaagtttcaagaaggttcttatggaaaaaaggctgtgagcatagaaagcagtcataggaggttggggaactagcttgtccctccccacccccagatcctgcaaaagaggtacaaagcttcccagagggccacagggcccagaccagagtcaagcctcttgttttaggagaaacctcagtggacaggcagggtagcccagtccttagatctgtggggaaggccctgagcccttctggagctaggagtggcaagagtgggagtcaagtatttgaccagcagagcctctatgtaggaatcatggtcactttaccaatactgatggggagggcctgttccccattgcaggcctagaatggtttgaatgggagaagtcaggaagtactgtagtagctgtaggggagagaagattctgagagccagaaggcaggaatggatttggttttgagcagggacgtggaaacgtggagaccaggtgaggtctcattattttggggcgaaaatgtgggttgctattaatactcctgcaatgggcgtgtgaatgtgttcccagaaatgagtggggaattccacccccaaaaagcactcgcggctgattcgcacctccaccgccagccgcacattagacctcaggctgcggcggggacacggcaggccgcagcagggacaggcggtgggggaagcctcggtgccggtcgccggcggagtcccccagcggcgggccagacacgcgcggcagaagctgtgctcgcacgccagaagcaccgggtcctcgaaggagcccccgcacagaggacacgtcgccagctgctccagacgctccaccagccccgggcccagctcgggcgcatccatggaaagccaggatctggacgccgccccttccgcgaccaccgtgaccgccttcgagcgcgcagatggcgggccgcccctgctgcttgctgtgtagatgcccttctctccgactcccgcattaacttttgccgctttccgcccctctcctgggattgcctctctcttcaaccagagtctcagtctcgtcaaatctctccaccacatcaggctttatagggagggaggaggctcccacgggaggtaaacaccaggccttgcgtaacgcc

SEQ ID NO: 369875 - DNA, 2907 bp, Homo sapiens
ctacaggcacagggcgaggggtagaaccacatcgcttgactcttaagtgtgtttccaactgctcccacttcccgttttctttagagaaacccagaccaaacaaggaaagggaaataggccacggtagggtcattactattgctccttaagcttcctcgccggtccacctacccagacaaggcaaacggaaatctgcagcaggactcagcttggtgcacacaactccgccctcgccacacccactctgcagcgtctggcccggcaatacccatctgggcgcccctcctgcttcctctaggctgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaatgtgttaaatatgggcccatttatacttatggggaagggtgtgagactatacacaaggatgagtttggagatgtctgaagtattcccaggttgaggaggagagaggggaaatagcaccattggttcctttccgtgagtatgtgcggggagaagtttcaagaaggttcttatggaaaaaaggctgtgagcatagaaagcagtcataggaggttggggaactagcttgtccctccccacccccagatcctgcaaaagaggtacaaagcttcccagagggccacagggcccagaccagagtcaagcctcttgttttaggagaaacctcagtggacaggcagggtagcccagtccttagatctgtggggaaggccctgagcccttctggagctaggagtggcaagagtgggagtcaagtatttgaccagcagagcctctatgtaggaatcatggtcactttaccaatactgatggggagggcctgttccccattgcaggcctagaatggtttgaatgggagaagtcaggaagtactgtagtagctgtaggggagagaagattctgagagccagaaggcaggaatggatttggttttgagcagggacgtggaaacgtggagaccaggtgaggtctcattattttggggcgaaaatgtgggttgctattaatactcctgcaatgggcgtgtgaatgtgttcccagaaatgagtggggaattccacccccaaaaagcactcgcggctgattcgcacctccaccgccagccgcacattagacctcaggctgcggcggggacacggcaggccgcagcagggacaggcggtgggggaagcctcggtgccggtcgccggcggagtcccccagcggcgggccagacacgcgcggcagaagctgtgctcgcacgccagaagcaccgggtcctcgaaggagcccccgcacagaggacacgtcgccagctgctccagacgctccaccagccccgggcccagctcgggcgcatccatggaaagccaggatctggacgccgccccttccgcgaccaccgtgaccgccttcgagcgcgcagatggcgggccgcccctgctgcttgctgtgtagatgcccttctctccgactcccgcattaacttttgccgctttccgcccctctcctgggattgcctctctcttcaaccagagtctcagtctcgtcaaatctctccaccacatcaggctttatagggagggaggaggctcccacgggaggtaaacaccaggccttgcgtaacgcc

SEQ ID NO: 369876 - DNA, 2806 bp, Homo sapiens
cagggattagaagagttgttggaggagctaggcctagggatatgggaggtgtggggttgaatatctagggctgggagaatcggaaggtattggagctatttggagtggcagagatggtgcaggaggatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaatgtgttaaatatgggcccatttatacttatggggaagggtgtgagactatacacaaggatgagtttggagatgtctgaagtattcccaggttgaggaggagagaggggaaatagcaccattggttcctttccgtgagtatgtgcggggagaagtttcaagaaggttcttatggaaaaaaggctgtgagcatagaaagcagtcataggaggttggggaactagcttgtccctccccacccccagatcctgcaaaagaggtacaaagcttcccagagggccacagggcccagaccagagtcaagcctcttgttttaggagaaacctcagtggacaggcagggtagcccagtccttagatctgtggggaaggccctgagcccttctggagctaggagtggcaagagtgggagtcaagtatttgaccagcagagcctctatgtaggaatcatggtcactttaccaatactgatggggagggcctgttccccattgcaggcctagaatggtttgaatgggagaagtcaggaagtactgtagtagctgtaggggagagaagattctgagagccagaaggcaggaatggatttggttttgagcagggacgtggaaacgtggagaccaggtgaggtctcattattttggggcgaaaatgtgggttgctattaatactcctgcaatgggcgtgtgaatgtgttcccagaaatgagtggggaattccacccccaaaaagcactcgcggctgattcgcacctccaccgccagccgcacattagacctcaggctgcggcggggacacggcaggccgcagcagggacaggcggtgggggaagcctcggtgccggtcgccggcggagtcccccagcggcgggccagacacgcgcggcagaagctgtgctcgcacgccagaagcaccgggtcctcgaaggagcccccgcacagaggacacgtcgccagctgctccagacgctccaccagccccgggcccagctcgggcgcatccatggaaagccaggatctggacgccgccccttccgcgaccaccgtgaccgccttcgagcgcgcagatggcgggccgcccctgctgcttgctgtgtagatgcccttctctccgactcccgcattaacttttgccgctttccgcccctctcctgggattgcctctctcttcaaccagagtctcagtctcgtcaaatctctccaccacatcaggctttatagggagggaggaggctcccacgggaggtaaacaccaggccttgcgtaacgcc

SEQ ID NO: 369877 - DNA, 2767 bp, Homo sapiens
cagggattagaagagttgttggaggagctaggcctagggatatgggaggtgtggggttgaatatctagggctgggagaatcggaaggatgatttggggaggaagacggagaaacagcaaggattatattttcctttgaagagttgctgggacctttcctaggagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaatgtgttaaatatgggcccatttatacttatggggaagggtgtgagactatacacaaggatgagtttggagatgtctgaagtattcccaggttgaggaggagagaggggaaatagcaccattggttcctttccgtgagtatgtgcggggagaagtttcaagaaggttcttatggaaaaaaggctgtgagcatagaaagcagtcataggaggttggggaactagcttgtccctccccacccccagatcctgcaaaagaggtacaaagcttcccagagggccacagggcccagaccagagtcaagcctcttgttttaggagaaacctcagtggacaggcagggtagcccagtccttagatctgtggggaaggccctgagcccttctggagctaggagtggcaagagtgggagtcaagtatttgaccagcagagcctctatgtaggaatcatggtcactttaccaatactgatggggagggcctgttccccattgcaggcctagaatggtttgaatgggagaagtcaggaagtactgtagtagctgtaggggagagaagattctgagagccagaaggcaggaatggatttggttttgagcagggacgtggaaacgtggagaccaggtgaggtctcattattttggggcgaaaatgtgggttgctattaatactcctgcaatgggcgtgtgaatgtgttcccagaaatgagtggggaattccacccccaaaaagcactcgcggctgattcgcacctccaccgccagccgcacattagacctcaggctgcggcggggacacggcaggccgcagcagggacaggcggtgggggaagcctcggtgccggtcgccggcggagtcccccagcggcgggccagacacgcgcggcagaagctgtgctcgcacgccagaagcaccgggtcctcgaaggagcccccgcacagaggacacgtcgccagctgctccagacgctccaccagccccgggcccagctcgggcgcatccatggaaagccaggatctggacgccgccccttccgcgaccaccgtgaccgccttcgagcgcgcagatggcgggccgcccctgctgcttgctgtgtagatgcccttctctccgactcccgcattaacttttgccgctttccgcccctctcctgggattgcctctctcttcaaccagagtctcagtctcgtcaaatctctccaccacatcaggctttatagggagggaggaggctcccacgggaggtaaacaccaggccttgcgtaacgcc

SEQ ID NO: 369878 - DNA, 2583 bp, Homo sapiens
aggagcgagtaaatgatgtatgagtgcgatacgcggttgtaatttcagtcacgaggcaggcggaggcccaggaggagggggaataagctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaatgtgttaaatatgggcccatttatacttatggggaagggtgtgagactatacacaaggatgagtttggagatgtctgaagtattcccaggttgaggaggagagaggggaaatagcaccattggttcctttccgtgagtatgtgcggggagaagtttcaagaaggttcttatggaaaaaaggctgtgagcatagaaagcagtcataggaggttggggaactagcttgtccctccccacccccagatcctgcaaaagaggtacaaagcttcccagagggccacagggcccagaccagagtcaagcctcttgttttaggagaaacctcagtggacaggcagggtagcccagtccttagatctgtggggaaggccctgagcccttctggagctaggagtggcaagagtgggagtcaagtatttgaccagcagagcctctatgtaggaatcatggtcactttaccaatactgatggggagggcctgttccccattgcaggcctagaatggtttgaatgggagaagtcaggaagtactgtagtagctgtaggggagagaagattctgagagccagaaggcaggaatggatttggttttgagcagggacgtggaaacgtggagaccaggtgaggtctcattattttggggcgaaaatgtgggttgctattaatactcctgcaatgggcgtgtgaatgtgttcccagaaatgagtggggaattccacccccaaaaagcactcgcggctgattcgcacctccaccgccagccgcacattagacctcaggctgcggcggggacacggcaggccgcagcagggacaggcggtgggggaagcctcggtgccggtcgccggcggagtcccccagcggcgggccagacacgcgcggcagaagctgtgctcgcacgccagaagcaccgggtcctcgaaggagcccccgcacagaggacacgtcgccagctgctccagacgctccaccagccccgggcccagctcgggcgcatccatggaaagccaggatctggacgccgccccttccgcgaccaccgtgaccgccttcgagcgcgcagatggcgggccgcccctgctgcttgctgtgtagatgcccttctctccgactcccgcattaacttttgccgctttccgcccctctcctgggattgcctctctcttcaaccagagtctcagtctcgtcaaatctctccaccacatcaggctttatagggagggaggaggctcccacgggaggtaaacaccaggccttgcgtaacgcc

SEQ ID NO: 369879 - DNA, 2912 bp, Homo sapiens
ggaagggaaaaagggggactgcagtatgcgtcacacccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacaccttcgccgtagacagcacaataaaaaaacccaaaaccaaaaaacaaaacaaaaacccaacaaaaaaaaaataaatgggatctggttttcattttccggtccttttgccatacacagttacagagatcagtcaaatccataccaccactgagatctcatttattgccacagatgcacaaaataaataacccaaaatcacaaaatgtgttaaatatgggcccatttatacttatggggaagggtgtgagactatacacaaggatgagtttggagatgtctgaagtattcccaggttgaggaggagagaggggaaatagcaccattggttcctttccgtgagtatgtgcggggagaagtttcaagaaggttcttatggaaaaaaggctgtgagcatagaaagcagtcataggaggttggggaactagcttgtccctccccacccccagatcctgcaaaagaggtacaaagcttcccagagggccacagggcccagaccagagtcaagcctcttgttttaggagaaacctcagtggacaggcagggtagcccagtccttagatctgtggggaaggccctgagcccttctggagctaggagtggcaagagtgggagtcaagtatttgaccagcagagcctctatgtaggaatcatggtcactttaccaatactgatggggagggcctgttccccattgcaggcctagaatggtttgaatgggagaagtcaggaagtactgtagtagctgtaggggagagaagattctgagagccagaaggcaggaatggatttggttttgagcagggacgtggaaacgtggagaccaggtgaggtctcattattttggggcgaaaatgtgggttgctattaatactcctgcaatgggcgtgtgaatgtgttcccagaaatgagtggggaattccacccccaaaaagcactcgcggctgattcgcacctccaccgccagccgcacattagacctcaggctgcggcggggacacggcaggccgcagcagggacaggcggtgggggaagcctcggtgccggtcgccggcggagtcccccagcggcgggccagacacgcgcggcagaagctgtgctcgcacgccagaagcaccgggtcctcgaaggagcccccgcacagaggacacgtcgccagctgctccagacgctccaccagccccgggcccagctcgggcgcatccatggaaagccaggatctggacgccgccccttccgcgaccaccgtgaccgccttcgagcgcgcagatggcgggccgcccctgctgcttgctgtgtagatgcccttctctccgactcccgcattaacttttgccgctttccgcccctctcctgggattgcctctctcttcaaccagagtctcagtctcgtcaaatctctccaccacatcaggctttatagggagggaggaggctcccacgggaggtaaacaccaggccttgcgtaacgcc

SEQ ID NO: 369880 - DNA, 906 bp, Homo sapiens
  misc_feature (837)..(837): n is a, c, g, or t
ggaagggaaaaagggggactgcagtatgcgtcacacccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacctttnccgcggggtcacgccctggcccggtgtccttgtgtcgccccgcgcctcgggtatttgggcggccatggg

SEQ ID NO: 369881 - DNA, 1785 bp, Homo sapiens
ggaagggaaaaagggggactgcagtatgcgtcacacccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagccctcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaatgtgttaaatatgggcccatttatacttatggggaagggtgtgagactatacacaaggatgagtttggagatgtctgaagtattcccaggttgaggaggagagaggggaaatagcaccattggttcctttccgtgagtatgtgcggggagaagtttcaagaaggttcttatggaaaaaaggctgtgagcatagaaagcagtcataggaggttggggaactagcttgtccctccccacccccagatcctgcaaaagaggtacaaagcttcccagagggccacagggcccagaccagagtcaagcctcttgttttaggagaaacctcagtggacaggcagggtagcccagtccttagatctgtggggaaggccctgagcccttctggagctaggagtggcaagagtgggagtcaagtatttgaccagcagagcctctatgtaggaatcatggtcactttaccaatactgatggggagggcctgttccccattgcaggcctagaatggtttgaatgggagaagtcaggaagtactgtagtagctgtaggggagagaagattctgagagccagaaggcaggaatggatttggttttgagcagggacgtggaaacgtggagaccaggtgaggtctcattattttggggcgaaaatgtgggttgctattaatactcctgcaatgggcgtgtgaatgtgttcccagaaatgagtggggaattccacccccaaaaagcactcgcggctgattcgcacctccaccgccagccgcacattagacctcaggctgcggcggggacacggcaggccgcagcagggacaggcggtgggggaagcctcggtgccggtcgccggcggagtcccccagcggcgggccagacacgcgcggcagaagctgtgctcgcacgccagaagcaccgggtcctcgaaggagcccccgcacagaggacacgtcgccagctgctccagacgctccaccagccccgggcccagctcgggcgcatccatggaaagccaggatctggacgccgccccttccgcgaccaccgtgaccgccttcgagcgcgcagatggcgggccgcccctgctgcttgctgtgtagatgcccttctctccgactcccgcattaacttttgccgctttccgcccctctcctgggattgcctctctcttcaaccagagtctcagtctcgtcaaatctctccaccacatcaggctttatagggagggaggaggctcccacgggaggtaaacaccaggccttgcgtaacgcc

SEQ ID NO: 369882 - DNA, 2917 bp, Homo sapiens
ggaagggaaaaagggggactgcagtatgcgtcacacccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaatgtgttaaatatgggcccatttatacttatggggaagggtgtgagactatacacaaggatgagtttggagatgtctgaagtattcccaggttgaggaggagagaggggaaatagcaccattggttcctttccgtgagtatgtgcggggagaagtttcaagaaggttcttatggaaaaaaggctgtgagcatagaaagcagtcataggaggttggggaactagcttgtccctccccacccccagatcctgcaaaagaggtacaaagcttcccagagggccacagggcccagaccagagtcaagcctcttgttttaggagaaacctcagtggacaggcagggtagcccagtccttagatctgtggggaaggccctgagcccttctggagctaggagtggcaagagtgggagtcaagtatttgaccagcagagcctctatgtaggaatcatggtcactttaccaatactgatggggagggcctgttccccattgcaggcctagaatggtttgaatgggagaagtcaggaagtactgtagtagctgtaggggagagaagattctgagagccagaaggcaggaatggatttggttttgagcagggacgtggaaacgtggagaccaggtgaggtctcattattttggggcgaaaatgtgggttgctattaatactcctgcaatgggcgtgtgaatgtgttcccagaaatgagtggggaattccacccccaaaaagcactcgcggctgattcgcacctccaccgccagccgcacattagacctcaggctgcggcggggacacggcaggccgcagcagggacaggcggtgggggaagcctcggtgccggtcgccggcggagtcccccagcggcgggccagacacgcgcggcagaagctgtgctcgcacgccagaagcaccgggtcctcgaaggagcccccgcacagaggacacgtcgccagctgctccagacgctccaccagccccgggcccagctcgggcgcatccatggaaagccaggatctggacgccgccccttccgcgaccaccgtgaccgccttcgagcgcgcagatggcgggccgcccctgctgcttgctgtgtagatgcccttctctccgactcccgcattaacttttgccgctttccgcccctctcctgggattgcctctctcttcaaccagagtctcagtctcgtcaaatctctccaccacatcaggctttatagggagggaggaggctcccacgggaggtaaacaccaggccttgcgtaacgcc

SEQ ID NO: 369883 - DNA, 2306 bp, Homo sapiens
ggaagggaaaaagggggactgcagtatgcgtcacacccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaaaaaaaaaaaaaaaaacacaacaaaaaaaaaacaaaacaaaaaaaacaaaaaaacaaaaaaaaaaaaaaaaaaaaaaaaaaaaaaaaaaaaaaaaaaaaaaaaagagagagggggggggcggcaaatccccgggggggccagacacaagaacgagccacacacccatttgttgagtcaaaaaaaggggccacacgaaaaagaggggcagaggataaaaaagaagaagaacagcggatgacgcgggagggtaaaaaaacagcagccgctgtgcgataaagaacaaggaagaggcagcagagaacgaacgtagtagaacaaggacaacagccaactctggcaggtgggggggggcgaagcacacaccctgggcggcggaggcaaaaacccactcccacgcgaagagagaaataacaagacgcccgcacgagagaggagagcaaacaaacctaccaccgctcgcggagggagacagagcgtgatagacggaggcggcgtaacacaccacgccgaggcgcactgcatcaagaagcgcgcgacaggcggaggagagaaaaaggaggaacagcccacagaggcaaaagagtcaccgcagcagaagaccaaaagtctacagccaacgcgggagccggcggctgcgagcacccaaacccgaaggc

SEQ ID NO: 369884 - DNA, 2612 bp, Homo sapiens
ggaagggaaaaagggggactgcagtatgcgtcacacccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccaccccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcacaaaataaataacccaaaatcacaaaatgtgttaaatatgggcccatttatacttatggggaagggtgtgagactatacacaaggatgagtttggagatgtctgaagtattcccaggttgaggaggagagaggggaaatagcaccattggttcctttccgtgagtatgtgcggggagaagtttcaagaaggttcttatggaaaaaaggctgtgagcatagaaagcagtcataggaggttggggaactagcttgtccctccccacccccagatcctgcaaaagaggtacaaagcttcccagagggccacagggcccagaccagagtcaagcctcttgttttaggagaaacctcagtggacaggcagggtagcccagtccttagatctgtggggaaggccctgagcccttctggagctaggagtggcaagagtgggagtcaagtatttgaccagcagagcctctatgtaggaatcatggtcactttaccaatactgatggggagggcctgttccccattgcaggcctagaatggtttgaatgggagaagtcaggaagtactgtagtagctgtaggggagagaagattctgagagccagaaggcaggaatggatttggttttgagcagggacgtggaaacgtggagaccaggtgaggtctcattattttggggcgaaaatgtgggttgctattaatactcctgcaatgggcgtgtgaatgtgttcccagaaatgagtggggaattccacccccaaaaagcactcgcggctgattcgcacctccaccgccagccgcacattagacctcaggctgcggcggggacacggcaggccgcagcagggacaggcggtgggggaagcctcggtgccggtcgccggcggagtcccccagcggcgggccagacacgcgcggcagaagctgtgctcgcacgccagaagcaccgggtcctcgaaggagcccccgcacagaggacacgtcgccagctgctccagacgctccaccagccccgggcccagctcgggcgcatccatggaaagccaggatctggacgccgccccttccgcgaccaccgtgaccgccttcgagcgcgcagatggcgggccgcccctgctgcttgctgtgtagatgcccttctctccgactcccgcattaacttttgccgctttccgcccctctcctgggattgcctctctcttcaaccagagtctcagtctcgtcaaatctctccaccacatcaggctttatagggagggaggaggctcccacgggaggtaaacaccaggccttgcgtaacgcc

SEQ ID NO: 369885 - DNA, 1658 bp, Homo sapiens
  misc_feature (1646)..(1646): n is a, c, g, or t
ggaagggaaaaagggggactgcagtatgcgtcacacccggaagcggcgagccggaagtggggttagccaggttatccccaggggtggagaagcggaggcccaggaggagggggaataaagaaggtggaggatcctggctaccactctgaatccgataccgcttctcttagacctcagcgacagaaaaagggaagggtgtctcatcccccttcctcctctcctccctgtcctgagccttagccatggccgaggcaggggctgggctgagcgagaccgtcactgagacaacggttaccgtgacaaccgagcccgagaaccggagccttaccatcaaacttcggaaacggaagccagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttcagcttcagagacagatccaatatagtcccagggacctgggtctctgggagaggaaggaagagggagggagcaaagagattggggtatgtcccctgtagtacactcttacctcttacttcctagactttgatttctccggcagcccagatgttcagttctcttggcccctctctaccccttactgggatctggttttcattttccggtccttttgccatacacagttacagagatcagtcaaatccataccaccactgagatctcatttattgccacagatgcaccaacccggacagggatcctctngaacagcctacc

SEQ ID NO: 369886 - DNA, 1015 bp, Homo sapiens
gtttcccagcctggagtacagtggtgtgatctcggctcactgcaaccttcgcctcccaggttcaagtgattctcctgcctcagccttccgagtagctgggactacaggcacctgcaaccacgcccagctaattttttgtatttttagtaaagacggagtttcaccatgttggccaggctagtctcgaactcctgacctcaggtgatccacccgcctcaacctcccaaagtgctgggattacaggtgtgagccaccacgcccagcctcttgtgaaatttttttctcagaatagcaatagcttatccaaagaaagctagtgtacatcttccaaagcttttaaaataaaaaagaggaggagttacacttgcagaatgtatatcttctgggatgcttctccctactccactggacactgtttgaaagtttgtagtttataatattcttacctaggctgtgttggtcagcttagaatatctaagtgataggataaaactaaagctgagtggcaaactgccagtctatatactgcatttagtctataggcttgttttgtttggcccacaaagcattttattatttaagtttatgccaacatttaagaatcaagaatttcccagacattcagatttctgacttcaattgaaaatctgacagtataaaccctattatattcctgcatggcataaaatcttcagttgctgaatggtgatatccacttttagaaagagtactctaccctgttctgcattcatacaacctaagccaacccgcccttcaccatcccacttctctttcaggttatctgcttaggctggtaggcatttgtgtttataaaccttgaactcaagctgctagatggtcagttgcattgtgaactgaactatctgaatgatttttcattgtaaatatatagctatagaaacactttaaattcctctttctataaaaagtgaagtagcaaaatttttggaccattcccaaggacaaacaataaaatagagggaaaatacagcaa

SEQ ID NO: 369887 - DNA, 209 bp, Homo sapiens
gtcttgaactcttggcctcaagcaatcctcccaaagtgctgggattacaggtgtgagccaccgtgtgtagtgttttttggtgtggtccaaaggctgactggttcagaacaatgtgaatgctcagaaaatagcagatttctggggtccactacaacacacttgccaaaccatgatctgtgaaagtgggagtcaggaatctgctaaaaaaa

SEQ ID NO: 369888 - DNA, 512 bp, Homo sapiens
tttgagacggagtctcgctctgtcgcccaggccagactgcggactgcagtggtgcaatctcggctcactgcaagctccgcttcccgggttcacgccattctcctgcctcagcctcccgagtagctgggactacaggcgcccgccaccgcgcccggctaattttttgtatttttagtagagacggggtgagtgtgtgcttttttaaggaattgcaaacgctccctgggaccagcaggtgggaggcagcctcatcgtcactcctggctgaaataatttaccccaagtcattgctgggtccctgagcacctgccttcattcaccctcatgccccagaatctcagggctacctccacagccctgtccacagacccctcctgacccgtctccaggggcctgggacccaccggcaggatgtggccctgttgaggccatgtcagggatgggtctggctgagagccgggctccagcccagggccctgtgtgagggttgggcacccagtgcacggaggggc

SEQ ID NO: 369889 - DNA, 435 bp, Homo sapiens
gctggccagacctccaactggtgggtaaaacgcagacatttccaaacaccaggaaatattttcttgggtgggtgggagttgggggacaaactgaatttctccctctgcagctgtctttattgccccagttgggaaacactgttttatacatcactatcttatgtgtctgctgatggagtttgctgatgctaaacaatgtctccaggtctccaggatggttttcttcctgtctgggtctctttctacacctcctgccaagtcctgcctgccccagtccttctctggggaatgggtctagttttcaggaccagatgcattgccagagattgtcagactgtgtcgagctccttttctcacatttgatggaaacagtctacacacatcagcaagccctgaatgcactgtgttaaattaaaaataactataagcttccca

SEQ ID NO: 369890 - DNA, 2342 bp, Homo sapiens
  misc_feature (1255)..(1255): n is a, c, g, or t
gcctggtgcacagagtctgcaggtcgggcggtagcgacaggtcagagctgcggcctgagcagccagcgtccggcatgaaggtctggggtctggctgctgcctgcttcttgctccagcaccatggaatgcctgcgcagtttaccctgcctcctgccccgcgcgatgagacttccccggcggacgctgtgtgccctggccttggacgtgacctctgtgggtcctcccgttgctgcctgcggccgccgagccaacctgattggaaggagccgagcggcgcagctttgcgggcccgaccggctccgcgtggcaggtgaagtgcaccggtttagaacctctgacgtctctcaagccactttagccagtgtagccccagtatttactgtgacaaaatttgacaaacagggaaacgttacttcttttgtatttgaaagctgtgataactccagagtgtcttctgatattagattatcgtaatttaaacttagagcaatggctgttccgggaactcccttcacagttgtctggagagggtcaactcgttacataccctttaccttttgagtttagagctatagaagcactcctgcaatattggatcaacacccttcaggggaaacttagcattttgcagccactgatccttgagaccttggatgctttggtggaccccaaacattcttctgtagacagaagcaaactgcacattttactacagaatggcaaaagtctatcagagttagaaacagatattaaaattttcaaagagtcaattttggagatcttggatgaggaagagttgctagaagagctctgtgtatcaaaatggagtgacccacaagtctttgaaaagagcagtgctgggattgaccatgcagaagagatggagttgctgttggaaaactactaccgattggctgacgatctctccaatgcagctcgtgagcttagggtgctgattgatgattcacaaagtattattttcattaatctggacagccaccgaaacgtgatgatgaggttgaatctacagctgaccatgggaaccttctctctttcgctctttggactaatgggagttgctttggaatgaatttggaatcttcccttgaagaggtgagaatgtattattatttctaaaacttgggggttttggccgggcatggtggctcatgtcagtaatcctagcactttaggaggctgaggcaggtggatcacctgaggtcaggagtttgagaccaacctggccaacatggcnaaaccctgtctctactaaaaatacaaaaattagacaggcacggtggcaggcacctgtaatcccagctacttgggaggctgaggcaggagaatcacttgaacccgggaggcggaggttgcagtgagctgagatcgcgccgttgcactccagcctgggagacagagtgagactctgtctccaaaaaaaaagattgggttttgaagatcgatatttttaatggatttaaaaaataaaggctgggcaccttggctcaacgcctgtaatcccagcactttgggaggctgaggcaggtagatcacgaggtcaggagatcgaggccatcctggctaacccggtgaaaccctgtctctactaaaaatacaaaaaattagccgggcgtggtggcagacgcctgtagtcccagctactccggaggctgaggcaggagaatggcatgaacctgggaggcggagcttgcagtgagccaggatcacaccactgcactccagcctgggcgacaggacagagtgagactctgtctcaaaaaataaataaataaaaagtctaacctgtaaactaccatggtgaaataaaatatataatgtaactcacaattcaggcagtactgttggaccatgttataacctagataaatacagcctaggttactttgtttcccaaaacatataattacagatgggaaaggtgtgataaaacagtgtctctgtgaagcagtgttaatgaagagtttttattttttaattcttacatgtctggcaacgtaccaggcggtttgcatactttatttggctcaatcattgcaactctgaaaatagatatattatccctactttgtagatgagaagactgaggctcagaacatttaacttgcccacaggcatagagctggaaaaataacagaattaggacatgaccccaaagacttgcactttctactgctctgttgcctttctgtattaagataatacttaactcccagagtttttcatttcactgtggttttgtacagtcatccctcagtatccaagaagaattggttacaggatccccacagataccaaagtctgtgggtattcaagtctctgat

SEQ ID NO: 369891 - DNA, 3343 bp, Homo sapiens
gcctggtgcacagagtctgcaggtcgggcggtagcgacaggtcagagctgcggcctgagcagccagcgtccggcatgaaggtctggggtctggctgctgcctgcttcttgctccagcaccatggaatgcctgcgcagtttaccctgcctcctgccccgcgcgatgagacttccccggcggacgctgtgtgccctggccttggacgtgacctctgtgggtcctcccgttgctgcctgcggccgccgagccaacctgattggaaggagccgagcggcgcagctttgcgggcccgaccggctccgcgtggcaggtgaagtgcaccggtttagaacctctgacgtctctcaagccactttagccagtgtagccccagtatttactgtgacaaaatttgacaaacagggaaacgttacttcttttgaaaggaagaaaactgaattataccaagagttaggtcttcaagccagagatttgagatttcagcatgtaatgagtatcacagtcagaaacaataggattatcatgagaatggagtatttgaaagctgtgataactccagagtgtcttctgatattagattatcgtaatttaaacttagagcaatggctgttccgggaactcccttcacagttgtctggagagggtcaactcgttacataccctttaccttttgagtttagagctatagaagcactcctgcaatattggatcaacacccttcaggggaaacttagcattttgcagccactgatccttgagaccttggatgctttggtggaccccaaacattcttctgtagacagaagcaaactgcacattttactacagaatggcaaaagtctatcagagttagaaacagatattaaaattttcaaagagtcaattttggagatcttggatgaggaagagttgctagaagagctctgtgtatcaaaatggagtgacccacaagtctttgaaaagagcagtgctgggattgaccatgcagaagagatggagttgctgttggaaaactactaccgattggctgacgatctctccaatgcagctcgtgagcttagggtgctgattgatgattcacaaagtattattttcattaatctggacagccaccgaaacgtgatgatgaggttgaatctacagctgaccatgggaaccttctctctttcgctctttggactaatgggagttgctttggaatgaatttggaatcttcccttgaagaggaccatagaattttttggctgattacaggaattatgttcatgggaagtggcctcatctggaggcgcctgctttcattccttggacgacagctagaagctccattgcctcctatgatggcttctttacctaaaaagactcttctggcagatagaagcatggaattgaaaaatagcctcagactggatggacttggatcaggaaggagcatcctaacaaaccgttaggaacagccccgtggatactgaagttttttttatggtagttacaggaaacttctgatactctttttattattttcttgtatagagtcagacacttgaaaaaaactaatgtttgaagacaaaaatattttggcagtcacaataccagaactggattgcatttccagaattctgagttaaagaaacaaagtatttgctttgtaaaaggccaaaattctatttcctacaaactttaaatgctgtttttatagatgtgatatgaggcaacacaagcacagacagttgcatagattttaatttatacatatcaagaaaagtgcaatttcatgctgaatgaagcgtaggaacttgacaagcccataggtagctatagttctttgtcagtatagggaattatgttcatgtgaatttcctgattctcaggtgactaaaaagctagcattctatgtattaaccttacaacagactctgtaagtttgagctttaaaaaccaaactttgacataaccttatttcttgtatttgcccccttttttttataaaaggtgaataaaaagaaataatttaatatcaccattgtatggattcctaatcaagatttcacgttctcagcccctgagactagttttctttgctctctgtaattagagcctttggaagcaaagttgaaaggaagtatttccattctgttactgttttgtagcactttgtccatttattgatttttaaagtagatatttagataccacccctgccctgccctgccccaaaaagaaaaatgtttattgtcctgctaatctatatgcctacacctcagaagctgacagatgagcttcctaaaacatgaggatgaataaatgttagaactgtgatatcttctcatttccacagagatttgggtttaaaacaaatggctaatatttgtaagcctgaaagctgccatcctctttaacatcctacctaccttttaaaatattttctggaggttaagtacagttaggcactagaacatttgttaagcctcccaaagtagtgtgcatggaagattctagagtgtccagctcttgcactacaaatgtaataataacagaataaatacacttaccctgatgatattgagggtacatgattagcctaatgtgatgtcatatgaggaagtttaggagtccatttttcaggtggtttggtgataggaataaaaatgttactcccgtcgctgatttggaagaaaaccgatgaagtacaagtaaggtttccccactcctgtgtgtggtcatgggaagccattagagggaagctggagaacagaatggaacaggacaggctgggctagactcgagcacgcagtggcccctgtgccaccacactgtgggtcaggaacacgcgtcatggtgttcttgtcggaatgtgaacatacagcaccctctagcattacgaatctcttaggatttttaagattgtatttgataatacttatatttcacagggcacacttttggcacacctcagagcacactgctgctattttgggtcgtatcactgtaaaatacataataagtactacttaactgtgacatgaagaattggaatcccagagggcaacatttgatttgactaagatcaggcataagatagaatttttgtcatttttccttgcagttttattgacttagtttatgagcttggataaaataattttttgatgaatcatgtcaataaaaggaaaaataatgtaactacctcataagtctgataaaaggaagttgctagtgttttatagaatttctgaaggtggttaaatcaagtatgatttcaaaatatcaactagttccacttttgtgattgcaggatgcttcttatactaaagttctcataaataataaatcagcttatgcc

SEQ ID NO: 369892 - DNA, 2024 bp, Homo sapiens
gcctggtgcacagagtctgcaggtcgggcggtagcgacaggtcagagctgcggcctgagcagccagcgtccggcatgaaggtctggggtctggctgctgcctgcttcttgctccagcaccatggaatgcctgcgcagtttaccctgcctcctgccccgcgcgatgagacttccccggcggacgctgtgtgccctggccttggacgtgacctctgtgggtcctcccgttgctgcctgcggccgccgagccaacctgattggaaggagccgagcggcgcagctttgcgggcccgaccggctccgcgtggcaggtgaagtgcaccggtttagaacctctgacgtctctcaagccactttagccagtgtagccccagtatttactgtgacaaaatttgacaaacagggaaacgttacttcttttgaaaggaagaaaactgaattataccaagagttaggtcttcaagccagagatttgagatttcagcatgtaatgagtatcacagtcagaaacaataggattatcatgagaatggagtatttgaaagctgtgataactccagagtgtcttctgatattagattatcgtaatttaaacttagagcaatggctgttccgggaactcccttcacagttgtctggagagggtcaactcgttacataccctttaccttttgagtttagagctatagaagcactcctgcaatattggatcaacacccttcaggggaaacttagcattttgcagccactgatccttgagaccttggatgctttggtggaccccaaacattcttctgtagacagaagcaaactgcacattttactacagaatggcaaaagtctatcagagttagaaacagatattaaaattttcaaagagtcaattttggagatcttggatgaggaagagttgctagaagagctctgtgtatcaaaatggagtgacccacaagtctttgaaaagagcagtgctgggattgaccatgcagaagagatggagttgctgttggaaaactactaccgattggctgacgatctctccaatgcagctcgtgagcttagggtgctgattgatgattcacaaagtattattttcattaatctggacagccaccgaaacgtgatgatgaggttgaatctacagctgaccatgggaaccttctctctttcgctctttggactaatgggagttgctttggaatgaatttggaatcttcccttgaagaggaccatagaattttttggctgattacaggaattatgttcatgggaagtggcctcatctggaggcgcctgctttcattccttggacgacagctagaagctccattgcctcctatgatggcttctttacctaaaaagactcttctggcagatagaagcatggaattgaaaaatagcctcagactggatggacttggatcaggaaggagcatcctaacaaaccgttaggaacagccccgtggatactgaagttttttttatggtagttacaggaaacttctgatactctttttattattttcttgtatagagtcagacacttgaaaaaaactaatgtttgaagacaaaaatattttggcagtcacaataccagaactggattgcatttccagaattctgagttaaagaaacaaagtatttgctttgtaaaaggccaaaattctatttcctacaaactttaaatgctgtttttatagatgtgatatgaggcaacacaagcacagacagttgcatagattttaatttatacatatcaagaaaagtgcaatttcatgctgaatgaagcgtaggaacttgacaagcccataggtagctatagttctttgtcagtatagggaattatgttcatgtgaatttcctgattctcaggtgactaaaaagctagcattctatgtattaaccttacaacagactctgtaagtttgagctttaaaaaccaaactttgacataaccttatttcttgtatttgcccccttttttttataaaaggtgagatggagtcttgctctgtcacccaggct

SEQ ID NO: 369893 - DNA, 3230 bp, Homo sapiens
gcctggtgcacagagtctgcaggtcgggcggtagcgacaggtcagagctgcggcctgagcagccagcgtccggcatgaaggtctggggtctggctgctgcctgcttcttgctccagcaccatggaatgcctgcgcagtttaccctgcctcctgccccgcgcgatgagacttccccggcggacgctgtgtgccctggccttggacgtgacctctgtgggtcctcccgttgctgcctgcggccgccgagccaacctgattggaaggagccgagcggcgcagctttgcgggcccgaccggctccgcgtggcaggtgaagtgcaccggtttagaacctctgacgtctctcaagccactttagccagtgtagccccagtatttactgtgacaaaatttgacaaacagggaaacgttacttcttttgtatttgaaagctgtgataactccagagtgtcttctgatattagattatcgtaatttaaacttagagcaatggctgttccgggaactcccttcacagttgtctggagagggtcaactcgttacataccctttaccttttgagtttagagctatagaagcactcctgcaatattggatcaacacccttcaggggaaacttagcattttgcagccactgatccttgagaccttggatgctttggtggaccccaaacattcttctgtagacagaagcaaactgcacattttactacagaatggcaaaagtctatcagagttagaaacagatattaaaattttcaaagagtcaattttggagatcttggatgaggaagagttgctagaagagctctgtgtatcaaaatggagtgacccacaagtctttgaaaagagcagtgctgggattgaccatgcagaagagatggagttgctgttggaaaactactaccgattggctgacgatctctccaatgcagctcgtgagcttagggtgctgattgatgattcacaaagtattattttcattaatctggacagccaccgaaacgtgatgatgaggttgaatctacagctgaccatgggaaccttctctctttcgctctttggactaatgggagttgctttggaatgaatttggaatcttcccttgaagaggaccatagaattttttggctgattacaggaattatgttcatgggaagtggcctcatctggaggcgcctgctttcattccttggacgacagctagaagctccattgcctcctatgatggcttctttacctaaaaagactcttctggcagatagaagcatggaattgaaaaatagcctcagactggatggacttggatcaggaaggagcatcctaacaaaccgttaggaacagccccgtggatactgaagttttttttatggtagttacaggaaacttctgatactctttttattattttcttgtatagagtcagacacttgaaaaaaactaatgtttgaagacaaaaatattttggcagtcacaataccagaactggattgcatttccagaattctgagttaaagaaacaaagtatttgctttgtaaaaggccaaaattctatttcctacaaactttaaatgctgtttttatagatgtgatatgaggcaacacaagcacagacagttgcatagattttaatttatacatatcaagaaaagtgcaatttcatgctgaatgaagcgtaggaacttgacaagcccataggtagctatagttctttgtcagtatagggaattatgttcatgtgaatttcctgattctcaggtgactaaaaagctagcattctatgtattaaccttacaacagactctgtaagtttgagctttaaaaaccaaactttgacataaccttatttcttgtatttgcccccttttttttataaaaggtgaataaaaagaaataatttaatatcaccattgtatggattcctaatcaagatttcacgttctcagcccctgagactagttttctttgctctctgtaattagagcctttggaagcaaagttgaaaggaagtatttccattctgttactgttttgtagcactttgtccatttattgatttttaaagtagatatttagataccacccctgccctgccctgccccaaaaagaaaaatgtttattgtcctgctaatctatatgcctacacctcagaagctgacagatgagcttcctaaaacatgaggatgaataaatgttagaactgtgatatcttctcatttccacagagatttgggtttaaaacaaatggctaatatttgtaagcctgaaagctgccatcctctttaacatcctacctaccttttaaaatattttctggaggttaagtacagttaggcactagaacatttgttaagcctcccaaagtagtgtgcatggaagattctagagtgtccagctcttgcactacaaatgtaataataacagaataaatacacttaccctgatgatattgagggtacatgattagcctaatgtgatgtcatatgaggaagtttaggagtccatttttcaggtggtttggtgataggaataaaaatgttactcccgtcgctgatttggaagaaaaccgatgaagtacaagtaaggtttccccactcctgtgtgtggtcatgggaagccattagagggaagctggagaacagaatggaacaggacaggctgggctagactcgagcacgcagtggcccctgtgccaccacactgtgggtcaggaacacgcgtcatggtgttcttgtcggaatgtgaacatacagcaccctctagcattacgaatctcttaggatttttaagattgtatttgataatacttatatttcacagggcacacttttggcacacctcagagcacactgctgctattttgggtcgtatcactgtaaaatacataataagtactacttaactgtgacatgaagaattggaatcccagagggcaacatttgatttgactaagatcaggcataagatagaatttttgtcatttttccttgcagttttattgacttagtttatgagcttggataaaataattttttgatgaatcatgtcaataaaaggaaaaataatgtaactacctcataagtctgataaaaggaagttgctagtgttttatagaatttctgaaggtggttaaatcaagtatgatttcaaaatatcaactagttccacttttgtgattgcaggatgcttcttatactaaagttctcataaataataaatcagcttatgcc

SEQ ID NO: 369894 - DNA, 2958 bp, Homo sapiens
gcctggtgcacagagtctgcaggtcgggcggtagcgacaggtcagagctgcggcctgagcagccagcgtccggcatgaaggtctggggtctggctgctgcctgcttcttgctccagcaccatggaatgcctgcgcagtttaccctgcctcctgccccgcgcgatgagacttccccggcggacgctgtgtgccctggccttggacgtgacctctgtgggtcctcccgttgctgcctgcggccgccgagccaacctgattggaaggagccgagcggcgcagctttgcgggcccgaccggctccgcgtggcaggtgaagtgcaccggtttagaacctctgacgtctctcaagccactttagccagtgtagccccagtatttactgtgacaaaatttgacaaacagggaaacgttacttcttttgaaaggaagaaaactgaattataccaagagttagtctatcagagttagaaacagatattaaaattttcaaagagtcaattttggagatcttggatgaggaagagttgctagaagagctctgtgtatcaaaatggagtgacccacaagtctttgaaaagagcagtgctgggattgaccatgcagaagagatggagttgctgttggaaaactactaccgattggctgacgatctctccaatgcagctcgtgagcttagggtgctgattgatgattcacaaagtattattttcattaatctggacagccaccgaaacgtgatgatgaggttgaatctacagctgaccatgggaaccttctctctttcgctctttggactaatgggagttgctttggaatgaatttggaatcttcccttgaagaggaccatagaattttttggctgattacaggaattatgttcatgggaagtggcctcatctggaggcgcctgctttcattccttggacgacagctagaagctccattgcctcctatgatggcttctttacctaaaaagactcttctggcagatagaagcatggaattgaaaaatagcctcagactggatggacttggatcaggaaggagcatcctaacaaaccgttaggaacagccccgtggatactgaagttttttttatggtagttacaggaaacttctgatactctttttattattttcttgtatagagtcagacacttgaaaaaaactaatgtttgaagacaaaaatattttggcagtcacaataccagaactggattgcatttccagaattctgagttaaagaaacaaagtatttgctttgtaaaaggccaaaattctatttcctacaaactttaaatgctgtttttatagatgtgatatgaggcaacacaagcacagacagttgcatagattttaatttatacatatcaagaaaagtgcaatttcatgctgaatgaagcgtaggaacttgacaagcccataggtagctatagttctttgtcagtatagggaattatgttcatgtgaatttcctgattctcaggtgactaaaaagctagcattctatgtattaaccttacaacagactctgtaagtttgagctttaaaaaccaaactttgacataaccttatttcttgtatttgcccccttttttttataaaaggtgaataaaaagaaataatttaatatcaccattgtatggattcctaatcaagatttcacgttctcagcccctgagactagttttctttgctctctgtaattagagcctttggaagcaaagttgaaaggaagtatttccattctgttactgttttgtagcactttgtccatttattgatttttaaagtagatatttagataccacccctgccctgccctgccccaaaaagaaaaatgtttattgtcctgctaatctatatgcctacacctcagaagctgacagatgagcttcctaaaacatgaggatgaataaatgttagaactgtgatatcttctcatttccacagagatttgggtttaaaacaaatggctaatatttgtaagcctgaaagctgccatcctctttaacatcctacctaccttttaaaatattttctggaggttaagtacagttaggcactagaacatttgttaagcctcccaaagtagtgtgcatggaagattctagagtgtccagctcttgcactacaaatgtaataataacagaataaatacacttaccctgatgatattgagggtacatgattagcctaatgtgatgtcatatgaggaagtttaggagtccatttttcaggtggtttggtgataggaataaaaatgttactcccgtcgctgatttggaagaaaaccgatgaagtacaagtaaggtttccccactcctgtgtgtggtcatgggaagccattagagggaagctggagaacagaatggaacaggacaggctgggctagactcgagcacgcagtggcccctgtgccaccacactgtgggtcaggaacacgcgtcatggtgttcttgtcggaatgtgaacatacagcaccctctagcattacgaatctcttaggatttttaagattgtatttgataatacttatatttcacagggcacacttttggcacacctcagagcacactgctgctattttgggtcgtatcactgtaaaatacataataagtactacttaactgtgacatgaagaattggaatcccagagggcaacatttgatttgactaagatcaggcataagatagaatttttgtcatttttccttgcagttttattgacttagtttatgagcttggataaaataattttttgatgaatcatgtcaataaaaggaaaaataatgtaactacctcataagtctgataaaaggaagttgctagtgttttatagaatttctgaaggtggttaaatcaagtatgatttcaaaatatcaactagttccacttttgtgattgcaggatgcttcttatactaaagttctcataaataataaatcagcttatgcc

SEQ ID NO: 369895 - DNA, 2904 bp, Homo sapiens
acaacaaaaagaggaggcagatttctgttcaataagtgacatgcatttcccatcagtgatagctggatccagttgtgtaacaggctatctttgaggaagtgagctctcaatcattggagccaatgataacagcatagctataaatgggattccttccttgtgagagattaaatttaaattctgtgattctgtacattaactaaaaacagtgtgctgcaaaatattaccactctgaaaatgacggtgaggaagaatgtttttctaagtctgaggttcccaaacttccttggatcacgatgcccttagtgtcttagtaattttttcacagtatcggaagacaaaaaatttattatgttacagattcctttatgttatttcccttgcaactttaaaatattctgaggtgctatcgtgcccagcatagcaccagacattcagctcacagtttgagaactgtggatataagcaaagaccttaaattgcgtgtcctctggcatcatgacttaagatttgcacgcatgtaaacaaaggctgcaaagaaacacaaagtaaaagcagtacatttggcatatagatgattttaaaatatttaaaaccttttaaatcatgttcttctcctgctttattctgtgggtgctatcaaggcccttgtttttcttagttcctttctacaggaaagagctgtacaaataacataaggctttcaaactctggggcagtaacaattcaaggaatcttctaaggaacctggcgttttgcgatggaaatgaactgtgttctcttttaggaccatagaattttttggctgattacaggaattatgttcatgggaagtggcctcatctggaggcgcctgctttcattccttggacgacagctagaagctccattgcctcctatgatggcttctttacctaaaaagactcttctggcagatagaagcatggaattgaaaaatagcctcagactggatggacttggatcaggaaggagcatcctaacaaaccgttaggaacagccccgtggatactgaagttttttttatggtagttacaggaaacttctgatactctttttattattttcttgtatagagtcagacacttgaaaaaaactaatgtttgaagacaaaaatattttggcagtcacaataccagaactggattgcatttccagaattctgagttaaagaaacaaagtatttgctttgtaaaaggccaaaattctatttcctacaaactttaaatgctgtttttatagatgtgatatgaggcaacacaagcacagacagttgcatagattttaatttatacatatcaagaaaagtgcaatttcatgctgaatgaagcgtaggaacttgacaagcccataggtagctatagttctttgtcagtatagggaattatgttcatgtgaatttcctgattctcaggtgactaaaaagctagcattctatgtattaaccttacaacagactctgtaagtttgagctttaaaaaccaaactttgacataaccttatttcttgtatttgcccccttttttttataaaaggtgaataaaaagaaataatttaatatcaccattgtatggattcctaatcaagatttcacgttctcagcccctgagactagttttctttgctctctgtaattagagcctttggaagcaaagttgaaaggaagtatttccattctgttactgttttgtagcactttgtccatttattgatttttaaagtagatatttagataccacccctgccctgccctgccccaaaaagaaaaatgtttattgtcctgctaatctatatgcctacacctcagaagctgacagatgagcttcctaaaacatgaggatgaataaatgttagaactgtgatatcttctcatttccacagagatttgggtttaaaacaaatggctaatatttgtaagcctgaaagctgccatcctctttaacatcctacctaccttttaaaatattttctggaggttaagtacagttaggcactagaacatttgttaagcctcccaaagtagtgtgcatggaagattctagagtgtccagctcttgcactacaaatgtaataataacagaataaatacacttaccctgatgatattgagggtacatgattagcctaatgtgatgtcatatgaggaagtttaggagtccatttttcaggtggtttggtgataggaataaaaatgttactcccgtcgctgatttggaagaaaaccgatgaagtacaagtaaggtttccccactcctgtgtgtggtcatgggaagccattagagggaagctggagaacagaatggaacaggacaggctgggctagactcgagcacgcagtggcccctgtgccaccacactgtgggtcaggaacacgcgtcatggtgttcttgtcggaatgtgaacatacagcaccctctagcattacgaatctcttaggatttttaagattgtatttgataatacttatatttcacagggcacacttttggcacacctcagagcacactgctgctattttgggtcgtatcactgtaaaatacataataagtactacttaactgtgacatgaagaattggaatcccagagggcaacatttgatttgactaagatcaggcataagatagaatttttgtcatttttccttgcagttttattgacttagtttatgagcttggataaaataattttttgatgaatcatgtcaataaaaggaaaaataatgtaactacctcataagtctgataaaaggaagttgctagtgttttatagaatttctgaaggtggttaaatcaagtatgatttcaaaatatcaactagttccacttttgtgattgcaggatgcttcttatactaaagttctcataaataataaatcagcttatgcc

SEQ ID NO: 369896 - DNA, 1778 bp, Homo sapiens
gcctggtgcacagagtctgcaggtcgggcggtagcgacaggtcagagctgcggcctgagcagccagcgtccggcatgaaggtctggggtctggctgctgcctgcttcttgctccagcaccatggaatgcctgcgcagtttaccctgcctcctgccccgcgcgatgagacttccccggcggacgctgtgtgccctggccttggacgtgacctctgtgggtcctcccgttgctgcctgcggccgccgagccaacctgattggaaggagccgagcggcgcagctttgcgggcccgaccggctccgcgtggcaggtgaagtgcaccggtttagaacctctgacgtctctcaagccactttagccagtgtagccccagtatttactgtgacaaaatttgacaaacagggaaacgttacttcttttgaaaggaagaaaactgaattataccaagagttaggtcttcaagccagagatttgagatttcagcatgtaatgagtatcacagtcagaaacaataggattatcatgagaatggagtatttgaaagctgtgataactccagagtgtcttctgatattagattatcgtaatttaaacttagagcaatggctgttccgggaactcccttcacagttgtctggagagggtcaactcgttacataccctttaccttttgagtttagagctatagaagcactcctgcaatattggatcaacacccttcaggggaaacttagcattttgcagccactgatccttgagaccttggatgctttggtggaccccaaacattcttctgtagacagaagcaaactgcacattttactacagaatggcaaaagtctatcagagttagaaacagatattaaaattttcaaagagtcaattttggagatcttggatgaggaagagttgctagaagagctctgtgtatcaaaatggagtgacccacaagtctttgaaaagagcagtgctgggattgaccatgcagaagagatggagttgctgttggaaaactactaccgattggctgacgatctctccaatgcagctcgtgagcttagggtgctgattgatgattcacaaagtattattttcattaatctggacagccaccgaaacgtgatgatgaggttgaatctacagctgaccatgggaaccttctctctttcgctctttggactaatgggagttgctttggaatgaatttggaatcttcccttgaagaggaccatagaattttttggctgattacaggaattatgttcatgggaagtggcctcatctggaggcgcctgctttcattccttggacgacagctagaagctccattgcctcctatggtatgaaggatatggttcacggcggtattgtggaagggttatgatcatgggccctaaagtcagagcgcctgggattaagttgtcacaggcactatggcccttgcgagttgctttctcaaacttccttcagtttccctatctgtcagttaagtcggtattacctgcttcatagggttatgggaagaattaaacaatatgtgtaaagcacttactagcacactgcctaacacaataagttagaaatataatttgtgtagaactctgacaacatacatttaaacagatgttagtaattctggtataaggtttgtcataaccaaatggaaatgtaggaaacatttataatgttcttaaaagatagaaaattcacctccattttctttgtacttgaagatggcaccactggaataaatacttaagacactgaaaaaaattata

SEQ ID NO: 369897 - DNA, 2455 bp, Homo sapiens
  misc_feature (1368)..(1368): n is a, c, g, or t
gcctggtgcacagagtctgcaggtcgggcggtagcgacaggtcagagctgcggcctgagcagccagcgtccggcatgaaggtctggggtctggctgctgcctgcttcttgctccagcaccatggaatgcctgcgcagtttaccctgcctcctgccccgcgcgatgagacttccccggcggacgctgtgtgccctggccttggacgtgacctctgtgggtcctcccgttgctgcctgcggccgccgagccaacctgattggaaggagccgagcggcgcagctttgcgggcccgaccggctccgcgtggcaggtgaagtgcaccggtttagaacctctgacgtctctcaagccactttagccagtgtagccccagtatttactgtgacaaaatttgacaaacagggaaacgttacttcttttgaaaggaagaaaactgaattataccaagagttaggtcttcaagccagagatttgagatttcagcatgtaatgagtatcacagtcagaaacaataggattatcatgagaatggagtatttgaaagctgtgataactccagagtgtcttctgatattagattatcgtaatttaaacttagagcaatggctgttccgggaactcccttcacagttgtctggagagggtcaactcgttacataccctttaccttttgagtttagagctatagaagcactcctgcaatattggatcaacacccttcaggggaaacttagcattttgcagccactgatccttgagaccttggatgctttggtggaccccaaacattcttctgtagacagaagcaaactgcacattttactacagaatggcaaaagtctatcagagttagaaacagatattaaaattttcaaagagtcaattttggagatcttggatgaggaagagttgctagaagagctctgtgtatcaaaatggagtgacccacaagtctttgaaaagagcagtgctgggattgaccatgcagaagagatggagttgctgttggaaaactactaccgattggctgacgatctctccaatgcagctcgtgagcttagggtgctgattgatgattcacaaagtattattttcattaatctggacagccaccgaaacgtgatgatgaggttgaatctacagctgaccatgggaaccttctctctttcgctctttggactaatgggagttgctttggaatgaatttggaatcttcccttgaagaggtgagaatgtattattatttctaaaacttgggggttttggccgggcatggtggctcatgtcagtaatcctagcactttaggaggctgaggcaggtggatcacctgaggtcaggagtttgagaccaacctggccaacatggcnaaaccctgtctctactaaaaatacaaaaattagacaggcacggtggcaggcacctgtaatcccagctacttgggaggctgaggcaggagaatcacttgaacccgggaggcggaggttgcagtgagctgagatcgcgccgttgcactccagcctgggagacagagtgagactctgtctccaaaaaaaaagattgggttttgaagatcgatatttttaatggatttaaaaaataaaggctgggcaccttggctcaacgcctgtaatcccagcactttgggaggctgaggcaggtagatcacgaggtcaggagatcgaggccatcctggctaacccggtgaaaccctgtctctactaaaaatacaaaaaattagccgggcgtggtggcagacgcctgtagtcccagctactccggaggctgaggcaggagaatggcatgaacctgggaggcggagcttgcagtgagccaggatcacaccactgcactccagcctgggcgacaggacagagtgagactctgtctcaaaaaataaataaataaaaagtctaacctgtaaactaccatggtgaaataaaatatataatgtaactcacaattcaggcagtactgttggaccatgttataacctagataaatacagcctaggttactttgtttcccaaaacatataattacagatgggaaaggtgtgataaaacagtgtctctgtgaagcagtgttaatgaagagtttttattttttaattcttacatgtctggcaacgtaccaggcggtttgcatactttatttggctcaatcattgcaactctgaaaatagatatattatccctactttgtagatgagaagactgaggctcagaacatttaacttgcccacaggcatagagctggaaaaataacagaattaggacatgaccccaaagacttgcactttctactgctctgttgcctttctgtattaagataatacttaactcccagagtttttcatttcactgtggttttgtacagtcatccctcagtatccaagaagaattggttacaggatccccacagataccaaagtctgtgggtattcaagtctctgat

SEQ ID NO: 369898 - DNA, 1876 bp, Homo sapiens
  misc_feature (65)..(65): n is a, c, g, or t
  misc_feature (67)..(67): n is a, c, g, or t
tgggacccccgggaacggagtttttatgtagtacgggaatttggaattttttatatttttggaangnttcagacacttgaaaaaaactaatgtttgaagacaaaaatattttggcagtcacaataccagaactggattgcatttccagaattctgagttaaagaaacaaagtatttgctttgtaaaaggccaaaattctatttcctacaaactttaaatgctgtttttatagatgtgatatgaggcaacacaagcacagacagttgcatagattttaatttatacatatcaagaaaagtgcaatttcatgctgaatgaagcgtaggaacttgacaagcccataggtagctatagttctttgtcagtatagggaattatgttcatgtgaatttcctgattctcaggtgactaaaaagctagcattctatgtattaaccttacaacagactctgtaagtttgagctttaaaaaccaaactttgacataaccttatttcttgtatttgcccccttttttttataaaaggtgaataaaaagaaataatttaatatcaccattgtatggattcctaatcaagatttcacgttctcagcccctgagactagttttctttgctctctgtaattagagcctttggaagcaaagttgaaaggaagtatttccattctgttactgttttgtagcactttgtccatttattgatttttaaagtagatatttagataccacccctgccctgccctgccccaaaaagaaaaatgtttattgtcctgctaatctatatgcctacacctcagaagctgacagatgagcttcctaaaacatgaggatgaataaatgttagaactgtgatatcttctcatttccacagagatttgggtttaaaacaaatggctaatatttgtaagcctgaaagctgccatcctctttaacatcctacctaccttttaaaatattttctggaggttaagtacagttaggcactagaacatttgttaagcctcccaaagtagtgtgcatggaagattctagagtgtccagctcttgcactacaaatgtaataataacagaataaatacacttaccctgatgatattgagggtacatgattagcctaatgtgatgtcatatgaggaagtttaggagtccatttttcaggtggtttggtgataggaataaaaatgttactcccgtcgctgatttggaagaaaaccgatgaagtacaagtaaggtttccccactcctgtgtgtggtcatgggaagccattagagggaagctggagaacagaatggaacaggacaggctgggctagactcgagcacgcagtggcccctgtgccaccacactgtgggtcaggaacacgcgtcatggtgttcttgtcggaatgtgaacatacagcaccctctagcattacgaatctcttaggatttttaagattgtatttgataatacttatatttcacagggcacacttttggcacacctcagagcacactgctgctattttgggtcgtatcactgtaaaatacataataagtactacttaactgtgacatgaagaattggaatcccagagggcaacatttgatttgactaagatcaggcataagatagaatttttgtcatttttccttgcagttttattgacttagtttatgagcttggataaaataattttttgatgaatcatgtcaataaaaggaaaaataatgtaactacctcataagtctgataaaaggaagttgctagtgttttatagaatttctgaaggtggttaaatcaagtatgatttcaaaatatcaactagttccacttttgtgattgcaggatgcttcttatactaaagttctcataaataataaatcagcttatgcc

SEQ ID NO: 369899 - DNA, 1393 bp, Homo sapiens
gcctggtgcacagagtctgcaggtcgggcggtagcgacaggtcagagctgcggcctgagcagccagcgtccggcatgaaggtctggggtctggctgctgcctgcttcttgctccagcaccatggaatgcctgcgcagtttaccctgcctcctgccccgcgcgatgagacttccccggcggacgctgtgtgccctggccttggacgtgacctctgtgggtcctcccgttgctgcctgcggccgccgagccaacctgattggaaggagccgagcggcgcagctttgcgggcccgaccggctccgcgtggcaggtgaagtgcaccggtttagaacctctgacgtctctcaagccactttagccagtgtagccccagtatttactgtgacaaaatttgacaaacagggaaacgttacttcttttgaaaggaagaaaactgaattataccaagagttagtctatcagagttagaaacagatattaaaattttcaaagagtcaattttggagatcttggatgaggaagagttgctagaagagctctgtgtatcaaaatggagtgacccacaagtctttgaaaagagcagtgctgggattgaccatgcagaagagatggagttgctgttggaaaactactaccgattggctgacgatctctccaatgcagctcgtgagcttagggtgctgattgatgattcacaaagtattattttcattaatctggacagccaccgaaacgtgatgatgaggttgaatctacagctgaccatgggaaccttctctctttcgctctttggactaatgggagttgctttggaatgaatttggaatcttcccttgaagaggaccatagaattttttggctgattacaggaattatgttcatgggaagtggcctcatctggaggcgcctgctttcattccttggacgacagctagaagctccattgcctcctatggtatgaaggatatggttcacggcggtattgtggaagggttatgatcatgggccctaaagtcagagcgcctgggattaagttgtcacaggcactatggcccttgcgagttgctttctcaaacttccttcagtttccctatctgtcagttaagtcggtattacctgcttcatagggttatgggaagaattaaacaatatgtgtaaagcacttactagcacactgcctaacacaataagttagaaatataatttgtgtagaactctgacaacatacatttaaacagatgttagtaattctggtataaggtttgtcataaccaaatggaaatgtaggaaacatttataatgttcttaaaagatagaaaattcacctccattttctttgtacttgaagatggcaccactggaataaatacttaagacactgaaaaaaattata

SEQ ID NO: 369900 - DNA, 1339 bp, Homo sapiens
acaacaaaaagaggaggcagatttctgttcaataagtgacatgcatttcccatcagtgatagctggatccagttgtgtaacaggctatctttgaggaagtgagctctcaatcattggagccaatgataacagcatagctataaatgggattccttccttgtgagagattaaatttaaattctgtgattctgtacattaactaaaaacagtgtgctgcaaaatattaccactctgaaaatgacggtgaggaagaatgtttttctaagtctgaggttcccaaacttccttggatcacgatgcccttagtgtcttagtaattttttcacagtatcggaagacaaaaaatttattatgttacagattcctttatgttatttcccttgcaactttaaaatattctgaggtgctatcgtgcccagcatagcaccagacattcagctcacagtttgagaactgtggatataagcaaagaccttaaattgcgtgtcctctggcatcatgacttaagatttgcacgcatgtaaacaaaggctgcaaagaaacacaaagtaaaagcagtacatttggcatatagatgattttaaaatatttaaaaccttttaaatcatgttcttctcctgctttattctgtgggtgctatcaaggcccttgtttttcttagttcctttctacaggaaagagctgtacaaataacataaggctttcaaactctggggcagtaacaattcaaggaatcttctaaggaacctggcgttttgcgatggaaatgaactgtgttctcttttaggaccatagaattttttggctgattacaggaattatgttcatgggaagtggcctcatctggaggcgcctgctttcattccttggacgacagctagaagctccattgcctcctatggtatgaaggatatggttcacggcggtattgtggaagggttatgatcatgggccctaaagtcagagcgcctgggattaagttgtcacaggcactatggcccttgcgagttgctttctcaaacttccttcagtttccctatctgtcagttaagtcggtattacctgcttcatagggttatgggaagaattaaacaatatgtgtaaagcacttactagcacactgcctaacacaataagttagaaatataatttgtgtagaactctgacaacatacatttaaacagatgttagtaattctggtataaggtttgtcataaccaaatggaaatgtaggaaacatttataatgttcttaaaagatagaaaattcacctccattttctttgtacttgaagatggcaccactggaataaatacttaagacactgaaaaaaattata

SEQ ID NO: 369901 - DNA, 541 bp, Homo sapiens
  misc_feature (470)..(470): n is a, c, g, or t
  misc_feature (482)..(482): n is a, c, g, or t
  misc_feature (489)..(489): n is a, c, g, or t
  misc_feature (491)..(491): n is a, c, g, or t
  misc_feature (508)..(509): n is a, c, g, or t
  misc_feature (533)..(533): n is a, c, g, or t
gcctggtgcacagagtctgcaggtcgggcggtagcgacaggtcagagctgcggcctgagcagccagcgtccggcatgaaggtctggggtctggctgctgcctgcttcttgctccagcaccatggaatgcctgcgcagtttaccctgcctcctgccccgcgcgatgagacttccccggcggacgctgtgtgccctggccttggacgtgacctctgtgggtcctcccgttgctgcctgcggccgccgagccaacctgattggaaggagccgagcggcgcagctttgcgggcccgaccggctccgcgtggcaggtgaagtgcaccggtttagaacctctgacgtctctcaagccactttagccagtgtagccccagtatttactgtgacaaaatttgacaaacagggaaacgttacttcttttgtgaaaaggaagaaaaacttgaattattaccaaagagttaagggtctttnaaagcccagaanattttgnanaatttccaagccattgnnaaatggggggtattcaaaaggtcnaggaaaaa

SEQ ID NO: 369902 - DNA, 3290 bp, Homo sapiens
gcctggtgcacagagtctgcaggtcgggcggtagcgacaggtcagagctgcggcctgagcagccagcgtccggcatgaaggtctggggtctggctgctgcctgcttcttgctccagcaccatggaatgcctgcgcagtttaccctgcctcctgccccgcgcgatgagacttccccggcggacgctgtgtgccctggccttggacgtgacctctgtgggtcctcccgttgctgcctgcggccgccgagccaacctgattggaaggagccgagcggcgcagctttgcgggcccgaccggctccgcgtggcaggtgaagtgcaccggtttagaacctctgacgtctctcaagccactttagccagtgtagccccagtatttactgtgacaaaatttgacaaacagggaaacgttacttcttttgaaaggaagaaaactgaattataccaagagttaggtcttcaagccagagatttgagatttcagcatgtaatgagtatcacagtcagaaacaataggattatcatgagaatggagtatttgaaagctgtgataactccagagtgtcttctgatattagattatcgtaatttaaacttagagcaatggctgttccgggaactcccttcacagttgtctggagagggtcaactcgttacataccctttaccttttgagtttagagctatagaagcactcctgcaatattggatcaacacccttcaggggaaacttagcattttgcagccactgatccttgagaccttggatgctttggtggaccccaaacattcttctgtagacagaagcaaactgcacattttactacagaatggcaaaagtctatcagagttagaaacagatattaaaattttcaaagagtcaattttggagatcttggatgaggaagagttgctagaagagctctgtgtatcaaaatggagtgacccacaagtctttgaaaagagcagtgctgggattgaccatgcagaagagatggagttgctgttggaaaactactaccgattggctgacgatctctccaatgcagctcgtgagcttagggtgctgattgatgattcacaaagtattattttcattaatctggacagccaccgaaacgtgatgatgaggttgaatctacagctgaccatgggaaccttctctctttcgctctttggactaatgggagttgctttggaatgaatttggaatcttcccttgaagaggaccatagaattttttggctgattacaggaattatgttcatgggaagtggcctcatctggaggcgcctgctttcattccttggacgacagctagaagctccattgcctcctatgatggcttctttacctaaaaagactcttctggcagatagaagcatggaattgacgttaggaacagccccgtggatactgaagttttttttatggtagttacaggaaacttctgatactctttttattattttcttgtatagagtcagacacttgaaaaaaactaatgtttgaagacaaaaatattttggcagtcacaataccagaactggattgcatttccagaattctgagttaaagaaacaaagtatttgctttgtaaaaggccaaaattctatttcctacaaactttaaatgctgtttttatagatgtgatatgaggcaacacaagcacagacagttgcatagattttaatttatacatatcaagaaaagtgcaatttcatgctgaatgaagcgtaggaacttgacaagcccataggtagctatagttctttgtcagtatagggaattatgttcatgtgaatttcctgattctcaggtgactaaaaagctagcattctatgtattaaccttacaacagactctgtaagtttgagctttaaaaaccaaactttgacataaccttatttcttgtatttgcccccttttttttataaaaggtgaataaaaagaaataatttaatatcaccattgtatggattcctaatcaagatttcacgttctcagcccctgagactagttttctttgctctctgtaattagagcctttggaagcaaagttgaaaggaagtatttccattctgttactgttttgtagcactttgtccatttattgatttttaaagtagatatttagataccacccctgccctgccctgccccaaaaagaaaaatgtttattgtcctgctaatctatatgcctacacctcagaagctgacagatgagcttcctaaaacatgaggatgaataaatgttagaactgtgatatcttctcatttccacagagatttgggtttaaaacaaatggctaatatttgtaagcctgaaagctgccatcctctttaacatcctacctaccttttaaaatattttctggaggttaagtacagttaggcactagaacatttgttaagcctcccaaagtagtgtgcatggaagattctagagtgtccagctcttgcactacaaatgtaataataacagaataaatacacttaccctgatgatattgagggtacatgattagcctaatgtgatgtcatatgaggaagtttaggagtccatttttcaggtggtttggtgataggaataaaaatgttactcccgtcgctgatttggaagaaaaccgatgaagtacaagtaaggtttccccactcctgtgtgtggtcatgggaagccattagagggaagctggagaacagaatggaacaggacaggctgggctagactcgagcacgcagtggcccctgtgccaccacactgtgggtcaggaacacgcgtcatggtgttcttgtcggaatgtgaacatacagcaccctctagcattacgaatctcttaggatttttaagattgtatttgataatacttatatttcacagggcacacttttggcacacctcagagcacactgctgctattttgggtcgtatcactgtaaaatacataataagtactacttaactgtgacatgaagaattggaatcccagagggcaacatttgatttgactaagatcaggcataagatagaatttttgtcatttttccttgcagttttattgacttagtttatgagcttggataaaataattttttgatgaatcatgtcaataaaaggaaaaataatgtaactacctcataagtctgataaaaggaagttgctagtgttttatagaatttctgaaggtggttaaatcaagtatgatttcaaaatatcaactagttccacttttgtgattgcaggatgcttcttatactaaagttctcataaataataaatcagcttatgcc

SEQ ID NO: 369903 - DNA, 3315 bp, Homo sapiens
gcctggtgcacagagtctgcaggtcgggcggtagcgacaggtcagagctgcggcctgagcagccagcgtccggcatgaaggtctggggtctggctgctgcctgcttcttgctccagcaccatggaatgcctgcgcagtttaccctgcctcctgccccgcgcgatgagacttccccggcggacgctgtgtgccctggccttggacgtgacctctgtgggtcctcccgttgctgcctgcggccgccgagccaacctgattggaaggagccgagcggcgcagctttgcgggcccgaccggctccgcgtggcaggtgaagtgcaccggtttagaacctctgacgtctctcaagccactttagccagtgtagccccagtatttactgtgacaaaatttgacaaacagggaaacgttacttcttttgaaaggaagaaaactgaattataccaagagttaggtcttcaagccagagatttgagatttcagcatgtaatgagtatcacagtcagaaacaataggattatcatgagaatggagtatttgaaagctgtgataactccagagtgtcttctgatattagattatcgtaatttaaacttagagcaatggctgttccgggaactcccttcacagttgtctggagagggtcaactcgttacataccctttaccttttgagtttagagctatagaagcactcctgcaatattggatcaacacccttcaggggaaacttagcattttgcagccactgatccttgagaccttggatgctttggtggaccccaaacattcttctgtagacagaagcaaactgcacattttactacagaatggcaaaagtctatcagagttagaaacagatattaaaattttcaaagagtcaattttggagatcttggatgaggaagagttgctagaagagctctgtgtatcaaaatggagtgacccacaagtctttgaaaagagcagtgctgggattgaccatgcagaagagatggagttgctgttggaaaactactaccgattggctgacgatctctccaatgcagctcgtgagcttagggtgctgattgatgattcacaaagtattattttcattaatctggacagccaccgaaacgtgatgatgaggttgaatctacagctgaccatgggaaccttctctctttcgctctttggactaatgggagttgctttggaatgaatttggaatcttcccttgaagaggaattatgttcatgggaagtggcctcatctggaggcgcctgctttcattccttggacgacagctagaagctccattgcctcctatgatggcttctttacctaaaaagactcttctggcagatagaagcatggaattgaaaaatagcctcagactggatggacttggatcaggaaggagcatcctaacaaaccgttaggaacagccccgtggatactgaagttttttttatggtagttacaggaaacttctgatactctttttattattttcttgtatagagtcagacacttgaaaaaaactaatgtttgaagacaaaaatattttggcagtcacaataccagaactggattgcatttccagaattctgagttaaagaaacaaagtatttgctttgtaaaaggccaaaattctatttcctacaaactttaaatgctgtttttatagatgtgatatgaggcaacacaagcacagacagttgcatagattttaatttatacatatcaagaaaagtgcaatttcatgctgaatgaagcgtaggaacttgacaagcccataggtagctatagttctttgtcagtatagggaattatgttcatgtgaatttcctgattctcaggtgactaaaaagctagcattctatgtattaaccttacaacagactctgtaagtttgagctttaaaaaccaaactttgacataaccttatttcttgtatttgcccccttttttttataaaaggtgaataaaaagaaataatttaatatcaccattgtatggattcctaatcaagatttcacgttctcagcccctgagactagttttctttgctctctgtaattagagcctttggaagcaaagttgaaaggaagtatttccattctgttactgttttgtagcactttgtccatttattgatttttaaagtagatatttagataccacccctgccctgccctgccccaaaaagaaaaatgtttattgtcctgctaatctatatgcctacacctcagaagctgacagatgagcttcctaaaacatgaggatgaataaatgttagaactgtgatatcttctcatttccacagagatttgggtttaaaacaaatggctaatatttgtaagcctgaaagctgccatcctctttaacatcctacctaccttttaaaatattttctggaggttaagtacagttaggcactagaacatttgttaagcctcccaaagtagtgtgcatggaagattctagagtgtccagctcttgcactacaaatgtaataataacagaataaatacacttaccctgatgatattgagggtacatgattagcctaatgtgatgtcatatgaggaagtttaggagtccatttttcaggtggtttggtgataggaataaaaatgttactcccgtcgctgatttggaagaaaaccgatgaagtacaagtaaggtttccccactcctgtgtgtggtcatgggaagccattagagggaagctggagaacagaatggaacaggacaggctgggctagactcgagcacgcagtggcccctgtgccaccacactgtgggtcaggaacacgcgtcatggtgttcttgtcggaatgtgaacatacagcaccctctagcattacgaatctcttaggatttttaagattgtatttgataatacttatatttcacagggcacacttttggcacacctcagagcacactgctgctattttgggtcgtatcactgtaaaatacataataagtactacttaactgtgacatgaagaattggaatcccagagggcaacatttgatttgactaagatcaggcataagatagaatttttgtcatttttccttgcagttttattgacttagtttatgagcttggataaaataattttttgatgaatcatgtcaataaaaggaaaaataatgtaactacctcataagtctgataaaaggaagttgctagtgttttatagaatttctgaaggtggttaaatcaagtatgatttcaaaatatcaactagttccacttttgtgattgcaggatgcttcttatactaaagttctcataaataataaatcagcttatgcc

SEQ ID NO: 369904 - DNA, 3034 bp, Homo sapiens
gcctggtgcacagagtctgcaggtcgggcggtagcgacaggtcagagctgcggcctgagcagccagcgtccggcatgaaggtctggggtctggctgctgcctgcttcttgctccagcaccatggaatgcctgcgcagtttaccctgcctcctgccccgcgcgatgagacttccccggcggacgctgtgtgccctggccttggacgtgacctctgtgggtcctcccgttgctgcctgcggccgccgagccaacctgattggaaggagccgagcggcgcagctttgcgggcccgaccggctccgcgtggcaggtgaagtgcaccggtttagaacctctgacgtctctcaagccactttagccagtgtagccccagtatttactgtgacaaaatttgacaaacagggaaacgttacttcttttgttagcattttgcagccactgatccttgagaccttggatgctttggtggaccccaaacattcttctgtagacagaagcaaactgcacattttactacagaatggcaaaagtctatcagagttagaaacagatattaaaattttcaaagagtcaattttggagatcttggatgaggaagagttgctagaagagctctgtgtatcaaaatggagtgacccacaagtctttgaaaagagcagtgctgggattgaccatgcagaagagatggagttgctgttggaaaactactaccgattggctgacgatctctccaatgcagctcgtgagcttagggtgctgattgatgattcacaaagtattattttcattaatctggacagccaccgaaacgtgatgatgaggttgaatctacagctgaccatgggaaccttctctctttcgctctttggactaatgggagttgctttggaatgaatttggaatcttcccttgaagaggaccatagaattttttggctgattacaggaattatgttcatgggaagtggcctcatctggaggcgcctgctttcattccttggacgacagctagaagctccattgcctcctatgatggcttctttacctaaaaagactcttctggcagatagaagcatggaattgaaaaatagcctcagactggatggacttggatcaggaaggagcatcctaacaaaccgttaggaacagccccgtggatactgaagttttttttatggtagttacaggaaacttctgatactctttttattattttcttgtatagagtcagacacttgaaaaaaactaatgtttgaagacaaaaatattttggcagtcacaataccagaactggattgcatttccagaattctgagttaaagaaacaaagtatttgctttgtaaaaggccaaaattctatttcctacaaactttaaatgctgtttttatagatgtgatatgaggcaacacaagcacagacagttgcatagattttaatttatacatatcaagaaaagtgcaatttcatgctgaatgaagcgtaggaacttgacaagcccataggtagctatagttctttgtcagtatagggaattatgttcatgtgaatttcctgattctcaggtgactaaaaagctagcattctatgtattaaccttacaacagactctgtaagtttgagctttaaaaaccaaactttgacataaccttatttcttgtatttgcccccttttttttataaaaggtgaataaaaagaaataatttaatatcaccattgtatggattcctaatcaagatttcacgttctcagcccctgagactagttttctttgctctctgtaattagagcctttggaagcaaagttgaaaggaagtatttccattctgttactgttttgtagcactttgtccatttattgatttttaaagtagatatttagataccacccctgccctgccctgccccaaaaagaaaaatgtttattgtcctgctaatctatatgcctacacctcagaagctgacagatgagcttcctaaaacatgaggatgaataaatgttagaactgtgatatcttctcatttccacagagatttgggtttaaaacaaatggctaatatttgtaagcctgaaagctgccatcctctttaacatcctacctaccttttaaaatattttctggaggttaagtacagttaggcactagaacatttgttaagcctcccaaagtagtgtgcatggaagattctagagtgtccagctcttgcactacaaatgtaataataacagaataaatacacttaccctgatgatattgagggtacatgattagcctaatgtgatgtcatatgaggaagtttaggagtccatttttcaggtggtttggtgataggaataaaaatgttactcccgtcgctgatttggaagaaaaccgatgaagtacaagtaaggtttccccactcctgtgtgtggtcatgggaagccattagagggaagctggagaacagaatggaacaggacaggctgggctagactcgagcacgcagtggcccctgtgccaccacactgtgggtcaggaacacgcgtcatggtgttcttgtcggaatgtgaacatacagcaccctctagcattacgaatctcttaggatttttaagattgtatttgataatacttatatttcacagggcacacttttggcacacctcagagcacactgctgctattttgggtcgtatcactgtaaaatacataataagtactacttaactgtgacatgaagaattggaatcccagagggcaacatttgatttgactaagatcaggcataagatagaatttttgtcatttttccttgcagttttattgacttagtttatgagcttggataaaataattttttgatgaatcatgtcaataaaaggaaaaataatgtaactacctcataagtctgataaaaggaagttgctagtgttttatagaatttctgaaggtggttaaatcaagtatgatttcaaaatatcaactagttccacttttgtgattgcaggatgcttcttatactaaagttctcataaataataaatcagcttatgcc

SEQ ID NO: 369905 - DNA, 2950 bp, Homo sapiens
gcctggtgcacagagtctgcaggtcgggcggtagcgacaggtcagagctgcggcctgagcagccagcgtccggcatgaaggtctggggtctggctgctgcctgcttcttgctccagcaccatggaatgcctgcgcagtttaccctgcctcctgccccgcgcgatgagacttccccggcggacgctgtgtgccctggccttggacgtgacctctgtgggtcctcccgttgctgcctgcggccgccgagccaacctgattggaaggagccgagcggcgcagctttgcgggcccgaccggctccgcgtggcaggtgaagtgcaccggtttagaacctctgacgtctctcaagccactttagccagtgtagccccagtatttactgtgtctatcagagttagaaacagatattaaaattttcaaagagtcaattttggagatcttggatgaggaagagttgctagaagagctctgtgtatcaaaatggagtgacccacaagtctttgaaaagagcagtgctgggattgaccatgcagaagagatggagttgctgttggaaaactactaccgattggctgacgatctctccaatgcagctcgtgagcttagggtgctgattgatgattcacaaagtattattttcattaatctggacaggtttcatccatgtggtctgtatagatttgatgaatgtgctgtatatagttagtgggcccttctaatctgaataggtgttctcctctccagccaccgaaacgtgatgatgaggttgaatctacagctgaccatgggaaccttctctctttcgctctttggactaatgggagttgctttggaatgaatttggaatcttcccttgaagaggaattatgttcatgggaagtggcctcatctggaggcgcctgctttcattccttggacgacagctagaagctccattgcctcctatgatggcttctttacctaaaaagactcttctggcagatagaagcatggaattgaaaaatagcctcagactggatggacttggatcaggaaggagcatcctaacaaaccgttaggaacagccccgtggatactgaagttttttttatggtagttacaggaaacttctgatactctttttattattttcttgtatagagtcagacacttgaaaaaaactaatgtttgaagacaaaaatattttggcagtcacaataccagaactggattgcatttccagaattctgagttaaagaaacaaagtatttgctttgtaaaaggccaaaattctatttcctacaaactttaaatgctgtttttatagatgtgatatgaggcaacacaagcacagacagttgcatagattttaatttatacatatcaagaaaagtgcaatttcatgctgaatgaagcgtaggaacttgacaagcccataggtagctatagttctttgtcagtatagggaattatgttcatgtgaatttcctgattctcaggtgactaaaaagctagcattctatgtattaaccttacaacagactctgtaagtttgagctttaaaaaccaaactttgacataaccttatttcttgtatttgcccccttttttttataaaaggtgaataaaaagaaataatttaatatcaccattgtatggattcctaatcaagatttcacgttctcagcccctgagactagttttctttgctctctgtaattagagcctttggaagcaaagttgaaaggaagtatttccattctgttactgttttgtagcactttgtccatttattgatttttaaagtagatatttagataccacccctgccctgccctgccccaaaaagaaaaatgtttattgtcctgctaatctatatgcctacacctcagaagctgacagatgagcttcctaaaacatgaggatgaataaatgttagaactgtgatatcttctcatttccacagagatttgggtttaaaacaaatggctaatatttgtaagcctgaaagctgccatcctctttaacatcctacctaccttttaaaatattttctggaggttaagtacagttaggcactagaacatttgttaagcctcccaaagtagtgtgcatggaagattctagagtgtccagctcttgcactacaaatgtaataataacagaataaatacacttaccctgatgatattgagggtacatgattagcctaatgtgatgtcatatgaggaagtttaggagtccatttttcaggtggtttggtgataggaataaaaatgttactcccgtcgctgatttggaagaaaaccgatgaagtacaagtaaggtttccccactcctgtgtgtggtcatgggaagccattagagggaagctggagaacagaatggaacaggacaggctgggctagactcgagcacgcagtggcccctgtgccaccacactgtgggtcaggaacacgcgtcatggtgttcttgtcggaatgtgaacatacagcaccctctagcattacgaatctcttaggatttttaagattgtatttgataatacttatatttcacagggcacacttttggcacacctcagagcacactgctgctattttgggtcgtatcactgtaaaatacataataagtactacttaactgtgacatgaagaattggaatcccagagggcaacatttgatttgactaagatcaggcataagatagaatttttgtcatttttccttgcagttttattgacttagtttatgagcttggataaaataattttttgatgaatcatgtcaataaaaggaaaaataatgtaactacctcataagtctgataaaaggaagttgctagtgttttatagaatttctgaaggtggttaaatcaagtatgatttcaaaatatcaactagttccacttttgtgattgcaggatgcttcttatactaaagttctcataaataataaatcagcttatgcc

SEQ ID NO: 369906 - DNA, 1724 bp, Homo sapiens
gcctggtgcacagagtctgcaggtcgggcggtagcgacaggtcagagctgcggcctgagcagccagcgtccggcatgaaggtctggggtctggctgctgcctgcttcttgctccagcaccatggaatgcctgcgcagtttaccctgcctcctgccccgcgcgatgagacttccccggcggacgctgtgtgccctggccttggacgtgacctctgtgggtcctcccgttgctgcctgcggccgccgagccaacctgattggaaggagccgagcggcgcagctttgcgggcccgaccggctccgcgtggcaggtgaagtgcaccggtttagaacctctgacgtctctcaagccactttagccagtgtagccccagtatttactgtgacaaaatttgacaaacagggaaacgttacttcttttgaaaggaagaaaactgaattataccaagagttaggtcttcaagccagagatttgagatttcagcatgtaatgagtatcacagtcagaaacaataggattatcatgagaatggagtatttgaaagctgtgataactccagagtgtcttctgatattagattatcgtaatttaaacttagagcaatggctgttccgggaactcccttcacagttgtctggagagggtcaactcgttacataccctttaccttttgagtttagagctatagaagcactcctgcaatattggatcaacacccttcaggggaaacttagcattttgcagccactgatccttgagaccttggatgctttggtggaccccaaacattcttctgtagacagaagcaaactgcacattttactacagaatggcaaaagtctatcagagttagaaacagatattaaaattttcaaagagtcaattttggagatcttggatgaggaagagttgctagaagagctctgtgtatcaaaatggagtgacccacaagtctttgaaaagagcagtgctgggattgaccatgcagaagagatggagttgctgttggtgctgattgatgattcacaaagtattattttcattaatctggacagccaccgaaacgtgatgatgaggttgaatctacagctgaccatgggaaccttctctctttcgctctttggactaatgggagttgctttggaatgaatttggaatcttcccttgaagaggaccatagaattttttggctgattacaggaattatgttcatgggaagtggcctcatctggaggcgcctgctttcattccttggacgacagctagaagctccattgcctcctatggtatgaaggatatggttcacggcggtattgtggaagggttatgatcatgggccctaaagtcagagcgcctgggattaagttgtcacaggcactatggcccttgcgagttgctttctcaaacttccttcagtttccctatctgtcagttaagtcggtattacctgcttcatagggttatgggaagaattaaacaatatgtgtaaagcacttactagcacactgcctaacacaataagttagaaatataatttgtgtagaactctgacaacatacatttaaacagatgttagtaattctggtataaggtttgtcataaccaaatggaaatgtaggaaacatttataatgttcttaaaagatagaaaattcacctccattttctttgtacttgaagatggcaccactggaataaatacttaagacactgaaaaaaattata

SEQ ID NO: 369907 - DNA, 3050 bp, Homo sapiens
gttatttaaggaaggtattagtggcaaattataggttataatagtattagtgaattttctttataatagtttttgtgtctgtgtgtgacatccataaaaactggatactctatttttgcattttatttggttgtaagattattttagagtattgttgactttggggacaagaagcttaaggatgaaatcagcaaatgtttattatgagtagtttgtgctaggaagtatgtaggatccaaaaaaagaaaaatctaatactgttgccttaataattttgcggcagcggctgcgagaggcggcggcacgacgacggtccctcagcccagccaccatgagcaccaagcagatcacttgcaggtattttatgcatggtgtgtgtcgggaaggaagtcagtgcctattctcacatgacttggcaaacagcaaaccgtccaccatctgcaagtactaccagaagggctactgtgcctatggaactcggtgcagatatgaccacacgaggccctctgctgcagctggaggtgctgtgggcaccatggcccacagtgtgccctccccagctttccacagtcctcaccctccttccgaggtcactgcatccattgtgaaaactaactcacatgaacccggaaagcgtgaaaagagaacattggttcttagagaccgaaatctctctggcatggctgaaaggaagacccagccgagcatggtgagtaatccaggcagctgcagcgacccccagcccagccccgagatgaagccgcattcctacctggatgccatcaggagtggccttgatgacgtggaggccagcagctcctacagcaacgagcagcagctgtgcccctacgcagctgctggggagtgccggtttggggatgcctgtgtctacctgcacggggaggtgtgtgaaatctgtaggctgcaagtcttgcacccattcgacccagagcagaggaaggctcacgaaaagatctgcatgttgacgttcgaacacgagatggaaaaggcctttgccttccaggcaagccaggacaaagtgtgcagtatctgcatggaagtgatcctggagaaggcctctgcttctgagaggagatttgggattctctccaattgcaatcacacgtactgtttgtcctgcatccggcagtggcggtgtgccaaacagtttgaaaacccaatcattaagtcttgtccagaatgccgtgtgatatcagagtttgtaattccaagtgtgtattgggtggaagatcagaataaaaagaacgagttgattgaagctttcaaacaggggatggggaaaaaagcctgtaaatactttgagcaaggcaaggggacctgcccatttggaagcaaatgtctttatcgccatgcttaccccgatgggcggctagcagagcctgagaaacctcggaaacagctcagttctcaaggcactgtgaggttctttaattcagtgcggctctgggatttcatcgagaaccgagaaagccggcatgtccccaacaatgaagatgtcgacatgacagagctcggggacctcttcatgcacctttctggagtggaatcatcagaaccctaaagagtagatggttgccctgcatcttgggctccatcggccgaaactttcccaagccagggtgtgcggagcttccctgtactgcagccaaggtgacgtgtgacttggatttgagtggagttgggcttagccttagtctcattcaatctccattattacagccatggggaagagtgaaagatataaagtaacctaattaaatgtatggaattgctatttttatagctgatatagttacacctcaagcccctcaggggtaacaactaacaaacacccaaactgtttggattgattgctttaaaaaacaaacctggctcttacctttgatcttttcttccccagaaatagtaaacttgcagctgcccctaatgcagcatatttttcttaccaaaggagtcttcagccctataaaaggattcctctatagtgtatttctctagtgtatttagtgtgtcgtcaaaattttgatttatacagagctttcaagaacacacaatgcaaagtgagcgcagcatagctgttaacaaacatacaacttttttctagggctttaagggtggtcatttttttcaagttctctcaagtgtcccaaatcagggtagcaatcttgttgccacatgtgcagcaaacaaagtggaagtatagatcttcttctcccttagggaggctcttgaaggagcaggaggtacagtactgggtagcagtctggccctcctgtcgtctggttggtgttggggcctccagccagggccctctaggggaaccaagcctctgctctcacctgtgggttcttgcccatcagggtaattgtattgagaactcaaatatacgtgcacttacatgtgtggttcgtactcaagtgatctattatctagctgcaaagcctggctttgatttgaaattttgtaaaaatttcatggcacccaaggtttctgattctgacccagcagtggtcctgaagagagctgatggcaagtcttgtagtcattttgattttaattgaagggtgagcataaccttgtgaaccagcactagcttgttccaagctggaatttatctaatctatttttgtgtttaaaaaagctgtacctaccaaataaataaatagtttataaaatgtattacttaaggtattagctgagtttagagtactttctgcttaattaatttttatacttaactcttcagtagaggtttacaaagagtacaaaggttaaattacaaattcattcccagcctaggctctgggcacatttcctgttcttgaattctgctcctgaagagggtgaacaaatggggcattcaagttgtgagctcagaattactttaaaaggaggtaacagccagccattacacctaaatttaatttattttattaaaataacataattgagggaccatcagataactgtattttgtcaggtgcaataaaaacaaaattaaaacccaaatcatcaagaaaaaaaaaaaa

SEQ ID NO: 369908 - DNA, 2502 bp, Homo sapiens
accggaggggcggcgtgcgccggcgtgcgccggcgtgacgcggctacgcgggatgggccgggccaggccaaggccgaggcggcagcggctgcgagaggcggcggcacgacgacggtccctcagcccagccaccatgagcaccaagcagatcacttgcaggtattttatgcatggtgtgtgtcgggaaggaagtcagtgcctattctcacatgacttggcaaacagcaaaccgtccaccatctgcaagtactaccagaagggctactgtgcctatggaactcggtgcagatatgaccacacgaggccctctgctgcagctggaggtgctgtgggcaccatggcccacagtgtgccctccccagctttccacagtcctcaccctccttccgaggtcactgcatccattgtgaaaactaactcacatgaacccggaaagcgtgaaaagagaacattggttcttagagaccgaaatctctctggcatggctgaaaggaagacccagccgagcatggtgagtaatccaggcagctgcagcgacccccagcccagccccgagatgaagccgcattcctacctggatgccatcaggagtggccttgatgacgtggaggccagcagctcctacagcaacgagcagcagctgtgcccctacgcagctgctggggagtgccggtttggggatgcctgtgtctacctgcacggggaggtgtgtgaaatctgtaggctgcaagtcttgcacccattcgacccagagcagaggaaggctcacgaaaagatctgcatgttgacgttcgaacacgagatggaaaaggcctttgccttccaggcaagccaggacaaagtgtgcagtatctgcatggaagtgatcctggagaaggcctctgcttctgagaggagatttgggattctctccaattgcaatcacacgtactgtttgtcctgcatccggcagtggcggtgtgccaaacagtttgaaaacccaatcattaagtcttgtccagaatgccgtgtgatatcagagtttgtaattccaagtgtgtattgggtggaagatcagaataaaaagaacgagttgattgaagctttcaaacaggggatggggaaaaaagcctgtaaatactttgagcaaggcaaggggacctgcccatttggaagcaaatgtctttatcgccatgcttaccccgatgggcggctagcagagcctgagaaacctcggaaacagctcagttctcaaggcactgtgaggttctttaattcagtgcggctctgggatttcatcgagaaccgagaaagccggcatgtccccaacaatgaagatgtcgacatgacagagctcggggacctcttcatgcacctttctggagtggaatcatcagaaccctaaagagtagatggttgccctgcatcttgggctccatcggccgaaactttcccaagccagggtgtgcggagcttccctgtactgcagccaaggtgacgtgtgacttggatttgagtggagttgggcttagccttagtctcattcaatctccattattacagccatggggaagagtgaaagatataaagtaacctaattaaatgtatggaattgctatttttatagctgatatagttacacctcaagcccctcaggggtaacaactaacaaacacccaaactgtttggattgattgctttaaaaaacaaacctggctcttacctttgatcttttcttccccagaaatagtaaacttgcagctgcccctaatgcagcatatttttcttaccaaaggagtcttcagccctataaaaggattcctctatagtgtatttctctagtgtatttagtgtgtcgtcaaaattttgatttatacagagctttcaagaacacacaatgcaaagtgagcgcagcatagctgttaacaaacatacaacttttttctagggctttaagggtggtcatttttttcaagttctctcaagtgtcccaaatcagggtagcaatcttgttgccacatgtgcagcaaacaaagtggaagtatagatcttcttctcccttagggaggctcttgaaggagcaggaggtacagtactgggtagcagtctggccctcctgtcgtctggttggtgttggggcctccagccagggccctctaggggaaccaagcctctgctctcacctgtgggttcttgcccatcagggtaattgtattgagaactcaaatatacgtgcacttacatgtgtggttcgtactcaagtgatctattatctagctgcaaagcctggctttgatttgaaattttgtaaaaatttcatggcacccaaggtttctgattctgacccagcagtggtcctgaagagagctgatggcaagtcttgtagtcattttgattttaattgaagggtgagcataaccttgtgaaccagcactagcttgttccaagctggaatttatctaatctatttttgtgtttaaaaaagctgtacctaccaaataaataaatagtttataaaatgta

SEQ ID NO: 369909 - DNA, 613 bp, Homo sapiens
  misc_feature (25)..(25): n is a, c, g, or t
ctcaacgctttatactttctcaacngctttacttccgtattgaattcaagtataatattaagtatgcatggaagtataaagcgttgagctcaacgctttatacttccacatgtgcagcaaacaaagtggaagtatagatcttcttctcccttagggaggctcttgaaggagcaggaggtacagtactgggtagcagtctggccctcctgtcgtctggttggtgttggggcctccagccagggccctctaggggaaccaagcctctgctctcacctgtgggttcttgcccatcagggtaattgtattgagaactcaaatatacgtgcacttacatgtgtggttcgtactcaagtgatctattatctagctgcaaagcctggctttgatttgaaattttgtaaaaatttcatggcacccaaggtttctgattctgacccagcagtggtcctgaagagagctgatggcaagtcttgtagtcattttgattttaattgaagggtgagcataaccttgtgaaccagcactagcttgttccaagctggaatttatctaatctatttttgtgtttaaaaaagctgtacctaccaaataaataaatagtttataaaatgta

SEQ ID NO: 369910 - DNA, 728 bp, Homo sapiens
gttatttaaggaaggtattagtggcaaattataggttataatagtattagtgaattttctttataatagtttttgtgtctgtgtgtgacatccataaaaactggatactctatttttgcattttatttggttgtaagattattttagagtattgttgactttggggacaagaagcttaaggatgaaatcagcaaatgtttattatgagtagtttgtgctaggaagtatgtaggatccaaaaaaagaaaaatctaatactgttgccttaataattttgcggcagcggctgcgagaggcggcggcacgacgacggtccctcagcccagccaccatgagcaccaagcagatcacttgcagccacagtcctcaccctccttccgaggtcactgcatccattgtgaaaactaactcacatgaacccggaaagcgtgaaaagagaacattggttcttagagaccgaagtgagtaagcggaagccttttgttgcgtctttttgcatagcactcttgttaatgcttggtgctcctttctagcctcctcttgtcaagaggactcctaacctaatacacctccagattgtctgcgcggagagacttcagaactgttctgaagaggctccatgtggctgcagatcattcaaatgatacattcgccctcgtgcccaaggctgggttgagctccaagactggcctggtaaaacataaaaacacaatctttttgtcaacatg

SEQ ID NO: 369911 - DNA, 966 bp, Homo sapiens
aaaacagtggctttattgggatgtaactccatcattagtcaaggagcatctgtgtatatcttttgataccacactatggtatttgatcctcaccacgaccagttaagtgggtagtataatcttcattttatagggaaaggtagcaaggcccagggaagttggttttgtgacatgttcttaagtggcagagctgggtcttgagcccagatcttctggtttcgttagtcatgccctttaagctccttgagaacagagagaacagtttttcacagagtgttttctcaattatgtggctcacattgaacatatctcaaatcaggaagatatatcttcacatagaaatatatgggatcatttgtttttctttcagaaaagctgtcattgaatcagttgtagtgcctctgaaatcactgttgtagaatcaaggaaatatatagatctctctccagtgcctaatagagcctttatacataatatatgcctggtaaatgtttgtatgctaagttcaagaataagctgattttataaagcaaaatgtgcttctaaaagttgtatgcctgtgcttgtctctgcaggtattttatgcatggtgtgtgtcgggaaggaagtcagtgcctattctcacatgacttggcaaacagcaaaccgtccaccatctgcaagtactaccagaagggctactgtgcctatggaactcggtgcaggcaaggactctgcaacagattccagctgtgacactgatttcatttggagaatgggtcttgataagggggaaattttaatgtaaaagtaatatggcaacatcacaaaaagtatggcaaataagtttaaaacctcagtttcagtaccctaaaactaattttcttttctttttttttttgagatagagtctctcactgttgcccaggctggagggcagtggtgcgatctcagttctctgcaacctccgcctccagggttctcctg

SEQ ID NO: 369912 - DNA, 2852 bp, Homo sapiens
accggaggggcggcgtgcgccggcgtgcgccggcgtgacgcggctacgcgggatgggccgggccaggccaaggccgaggcggcagcggctgcgagaggcggcggcacgacgacggtccctcagcccagccaccatgagcaccaagcagatcacttgcaggtattttatgcatggtgtgtgtcgggaaggaagtcagtgcctattctcacatgacttggcaaacagcaaaccgtccaccatctgcaagtactaccagaagggctactgtgcctatggaactcggtgcagatatgaccacacgaggccctctgctgcagctggaggtgctgtgggcaccatggcccacagtgtgccctccccagctttccacagtcctcaccctccttccgaggtcactgcatccattgtgaaaactaactcacatgaacccggaaagcgtgaaaagagaacattggttcttagagaccgaaatctctctggcatggctgaaaggaagacccagccgagcatggtgagtaatccaggcagctgcagcgacccccagcccagccccgagatgaagccgcattcctacctggatgccatcaggagtggccttgatgacgtggaggccagcagctcctacagcaacgagcagcagctgtgcccctacgcagctgctggggagtgccggtttggggatgcctgtgtctacctgcacggggaggtgtgtgaaatctgtaggctgcaagtcttgcacccattcgacccagagcagaggaaggctcacgaaaagatctgcatgttgacgttcgaacacgagatggaaaaggcctttgccttccaggcaagccaggacaaagtgtgcagtatctgcatggaagtgatcctggagaaggcctctgcttctgagaggagatttgggattctctccaattgcaatcacacgtactgtttgtcctgcatccggcagtggcggtgtgccaaacagtttgaaaacccaatcattaagtcttgtccagaatgccgtgtgatatcagagtttgtaattccaagtgtgtattgggtggaagatcagaataaaaagaacgagttgattgaagctttcaaacaggggatggggaaaaaagcctgtaaatactttgagcaaggcaaggggacctgcccatttggaagcaaatgtctttatcgccatgcttaccccgatgggcggctagcagagcctgagaaacctcggaaacagctcagttctcaaggcactgtgaggttctttaattcagtgcggctctgggatttcatcgagaaccgagaaagccggcatgtccccaacaatgaagatgtcgacatgacagagctcggggacctcttcatgcacctttctggagtggaatcatcagaaccctaaagagtagatggttgccctgcatcttgggctccatcggccgaaactttcccaagccagggtgtgcggagcttccctgtactgcagccaaggtgacgtgtgacttggatttgagtggagttgggcttagccttagtctcattcaatctccattattacagccatggggaagagtgaaagatataaagtaacctaattaaatgtatggaattgctatttttatagctgatatagttacacctcaagcccctcaggggtaacaactaacaaacacccaaactgtttggattgattgctttaaaaaacaaacctggctcttacctttgatcttttcttccccagaaatagtaaacttgcagctgcccctaatgcagcatatttttcttaccaaaggagtcttcagccctataaaaggattcctctatagtgtatttctctagtgtatttagtgtgtcgtcaaaattttgatttatacagagctttcaagaacacacaatgcaaagtgagcgcagcatagctgttaacaaacatacaacttttttctagggctttaagggtggtcatttttttcaagttctctcaagtgtcccaaatcagggtagcaatcttgttgccacatgtgcagcaaacaaagtggaagtatagatcttcttctcccttagggaggctcttgaaggagcaggaggtacagtactgggtagcagtctggccctcctgtcgtctggttggtgttggggcctccagccagggccctctaggggaaccaagcctctgctctcacctgtgggttcttgcccatcagggtaattgtattgagaactcaaatatacgtgcacttacatgtgtggttcgtactcaagtgatctattatctagctgcaaagcctggctttgatttgaaattttgtaaaaatttcatggcacccaaggtttctgattctgacccagcagtggtcctgaagagagctgatggcaagtcttgtagtcattttgattttaattgaagggtgagcataaccttgtgaaccagcactagcttgttccaagctggaatttatctaatctatttttgtgtttaaaaaagctgtacctaccaaataaataaatagtttataaaatgtattacttaaggtattagctgagtttagagtactttctgcttaattaatttttatacttaactcttcagtagaggtttacaaagagtacaaaggttaaattacaaattcattcccagcctaggctctgggcacatttcctgttcttgaattctgctcctgaagagggtgaacaaatggggcattcaagttgtgagctcagaattactttaaaaggaggtaacagccagccattacacctaaatttaatttattttattaaaataacataattgagggaccatcagataactgtattttgtcaggtgcaataaaaacaaaattaaaacccaaatcatcaagaaaaaaaaaaaa

SEQ ID NO: 369913 - DNA, 1164 bp, Homo sapiens
gtaaaaagcaagaatcatagtatttattgaaggctgatatgtgtcagtgacagttctcagctcttcacaagaatcagtccattgttttcctacaattctatgagataggtactatcactgtgctccttttataggtgagtcaatgaggtgtacagagagtttcagtaacgagttggtggtagatctgagacttggactcaggcttgcaggcaccagcacccccacactttaagtaagaagttagttattgccgggcgcggtggctcaatcctgtaatcccagcactttgggagaccgaggtaggaggatcacgaggtcaggagtatgagaccatcctggccaacatggtgaaaccccatctctactaaaatacaaaaaattagcggggtgtggtggtgcacacctgtagtcccagctactcaggagggtgaggcaggagaatcccttgaacctgggaggcagagattgcgccactgcactccagcctgggcgacagagcgagactccgtctcaaaaaaaaaaaagaaaaaaaaagtcagttattcagaagaaggaacaaaaaattatatactagagtaatgaattggctgggctttgaaaaatggatatgattatgagtttaaagggagagaggacattttaggttcttgaacccctatgatgaaagatacagaggtcttccaagacagtgggaggacattgagtaaacctgcctggttagagtagaatacaggagtgatgaggttggaaagatccgaaaggggtggagtatggaataaatgctaaatttaaagtatttagtggaaagtatattttaagcagggagataatgtgtaaagatgggttttaggaagattaatatgaaggaagtgatgattcccagagatttaaataataaagatgtcttaggagtatcctgtctcactatctttatagtttaattaagaagtactttaggtagaacatttcaagtacttatgcgagggaaatgaggaaatgaccagattccaagaagccaagagagattagtttataatatactgaattagccagaacagatcatttataatgtttgagtctaggatcccattttgcactcagatggacatgtgcttttctaggattgtttgaacttgtcgttagtataattctttcctctttttc

SEQ ID NO: 369914 - DNA, 780 bp, Homo sapiens
gtaaaaagcaagaatcatagtatttattgaaggctgatatgtgtcagtgacagttctcagctcttcacaagaatcagtccattgttttcctacaattctatgagataggtactatcactgtgctccttttataggtgagtcaatgaggtgtacagagagtttcagtaacgagttggtggtagatctgagacttggactcaggcttgcaggcaccagcacccccacactttaagtaagaagttagttattgccgggcgcggtggctcaatcctgtaatcccagcactttgggagaccgaggtaggaggatcacgaggtcaggagtatgagaccatcctggccaacatggtgaaaccccatctctactaaaatacaaaaaattagcggggtgtggtggtgcacacctgtagtcccagctactcaggagggtgaggcaggagaatcccttgaacctgggaggcagagattgcgccactgcactccagcctgggcgacagagcgagactccgtctcaaaaaaaaaaaagaaaaaaaaagtcagttattcagaagaaggaacaaaaaattatatactagagtaatgaattggctgggctttgaaaaatggatatgattatgagtttaaagggagagaggacattttaggttcttgaacccctatgatgaaagatacagaggtaaaacttccaaggtgtgtgaatcgcttgagcccaggagttggagaccatcctgggcaacatagtgagacctcgcctctactaaataaaaatattagccaagca

SEQ ID NO: 369915 - DNA, 1115 bp, Homo sapiens
gtaaaaagcaagaatcatagtatttattgaaggctgatatgtgtcagtgacagttctcagctcttcacaagaatcagtccattgttttcctacaattctatgagataggtactatcactgtgctccttttataggtgagtcaatgaggtgtacagagagtttcagtaacgagttggtggtagatctgagacttggactcaggcttgcaggcaccagcacccccacactttaagtaagaagttagttattgccgggcgcggtggctcaatcctgtaatcccagcactttgggagaccgaggtaggaggatcacgaggtcaggagtatgagaccatcctggccaacatggtgaaaccccatctctactaaaatacaaaaaattagcggggtgtggtggtgcacacctgtagtcccagctactcaggagggtgaggcaggagaatcccttgaacctgggaggcagagattgcgccactgcactccagcctgggcgacagagcgagactccgtctcaaaaaaaaaaaagaaaaaaaaagtcagttattcagaagaaggaacaaaaaattatatactagagtaatgaattggctgggctttgaaaaatggatatgattatgagtttaaagggagagaggacattttaggttcttgaacccctatgatgaaagatacagaggtaatacaggagtgatgaggttggaaagatccgaaaggggtggagtatggaataaatgctaaatttaaagtatttagtggaaagtatattttaagcagggagataatgtgtaaagatgggttttaggaagattaatatgaaggaagtgatgattcccagagatttaaataataaagatgtcttaggagtatcctgtctcactatctttatagtttaattaagaagtactttaggtagaacatttcaagtacttatgcgagggaaatgaggaaatgaccagattccaagaagccaagagagattagtttataatatactgaattagccagaacagatcatttataatgtttgagtctaggatcccattttgcactcagatggacatgtgcttttctaggattgtttgaacttgtcgttagtataattctttcctctttttc

SEQ ID NO: 369916 - DNA, 1062 bp, Homo sapiens
ggccgcatgggccgccgggatgtgtagtccgcaggagtccggcatgaccgccttgagcgcgaggatgctgacccggagccggagcctgggacccggggctgggccgcgggggtgtagggaggagcccgggcctctccggagaagagaggctgcagcagaagcgaggaaaagccacagccccgtgaagcgtccgcggaaagcacagagactgcgtgtggcctatgagggctcggacagtgagaaaggtgagggggctgagcccctcaaggtgccagtctgggagccccaggactggcagcaacagctggtcaacatccgtgccatgaggaacaaaaaggatgcacctgtggaccatctggggactgagcactgctatgactccagtgcccccccaaaggtacgcaggtaccaggtgctgctgtcactgatgctctccagccaaaccaaagaccaggtgacggcgggcgccatgcagcgactgcgggcgcggggcctgacggtggacagcatcctgcagacagatgatgccacgctgggcaagctcatctaccccgtcggtttctggaggagcaaggtgaaatacatcaagcagaccagcgccatcctgcagcagcactacggtggggacatcccagcctctgtggccgagctggtggcgctgccgggtgttgggcccaagatggcacacctggctatggctgtggcctggggcactgtgtcaggcattgcagtggacacgcatgtgcacagaatcgccaacaggctgaggtggaccaagaaggcaaccaagtccccagaggagacccgcgccgccctggaggagtggctgcctagggagctgtggcacgagatcaatggactcttggtgggcttcggccagcagacctgtctgcctgtgcaccctcgctgccacgcctgcctcaaccaagccctctgcccggccgcccagggtctctgatggccgcatggctctggccgaggtgccgctgtggccaccgtctgtgaagtggctttacgcttcaggaagccacgcctgttgaataaagctttggtgtgtttgca

SEQ ID NO: 369917 - DNA, 491 bp, Homo sapiens
caagatggtcacatgtaggcttgcagccagggctttgcggttccaatgtctaactggagggccacgggggtggtggcagactcgcctctgggcggggaggggcacgggctaggctggtggagtgtgcccctgttcaccccgcttggcctcccagcagcagtggacacgcatgtgcacagaatcgccaacaggctgaggtggaccaagaaggcaaccaagtccccagaggagacccgcgccgccctggaggagtggctgcctagggagctgtggcacgagatcaatggactcttggtgggcttcggccagcagacctgtctgcctgtgcaccctcgctgccacgcctgcctcaaccaagccctctgcccggccgcccagggtctctgatggccgcatggctctggccgaggtgccgctgtggccaccgtctgtgaagtggctttacgcttcaggaagccacgcctgttgaataaagctttggtgtgtttgca

SEQ ID NO: 369918 - DNA, 910 bp, Homo sapiens
ggccgcatgggccgccgggatgtgtagtccgcaggagtccggcatgaccgccttgagcgcgaggatgctgacccggagccggagcctgggacccggggctgggccgcgggggtgtagggaggagcccgggcctctccggagaagagaggctgcagcagaagcgaggaaaagccacagccccgtgaagcgtccgcggaaagcacagagactgcgtgtggcctatgagggctcggacagtgagaaaggtacgcaggtaccaggtgctgctgtcactgatgctctccagccaaaccaaagaccaggtgacggcgggcgccatgcagcgactgcgggcgcggggcctgacggtggacagcatcctgcagacagatgatgccacgctgggcaagctcatctaccccgtcggtttctggaggagcaaggtgaaatacatcaagcagaccagcgccatcctgcagcagcactacggtggggacatcccagcctctgtggccgagctggtggcgctgccgggtgttgggcccaagatggcacacctggctatggctgtggcctggggcactgtgtcaggcattgcagtggacacgcatgtgcacagaatcgccaacaggctgaggtggaccaagaaggcaaccaagtccccagaggagacccgcgccgccctggaggagtggctgcctagggagctgtggcacgagatcaatggactcttggtgggcttcggccagcagacctgtctgcctgtgcaccctcgctgccacgcctgcctcaaccaagccctctgcccggccgcccagggtctctgatggccgcatggctctggccgaggtgccgctgtggccaccgtctgtgaagtggctttacgcttcaggaagccacgcctgttgaataaagctttggtgtgtttgca

SEQ ID NO: 369919 - DNA, 535 bp, Homo sapiens
ggccgcatgggccgccgggatgtgtagtccgcaggagtccggcatgaccgccttgagcgcgaggatgctgacccggagccggagcctgggacccggggctgggccgcgggggtgtagggaggagcccgggcctctccggagaagagaggctgcagcagaagcgaggaaaagccacagccccgtgaagcgtccgcggaaagcacagagactgcgtgtggcctatgagggctcggacagtgagaaaggtgagggggctgagcccctcaaggtgccagtctgggagccccaggactggcagcaacagctggtcaacatccgtgccatgaggaacaaaaaggatgcacctgtggaccatctggggactgagcactgctatgactccagtgcccccccaaaggtaggcaggggccccatctgcccagatgacccccatcttagcaaggtccttgttttctttctacccggtggcttttggctggcaccctcccctgcagacagcaccttgggaggatggacacccggtgccccagagcat

SEQ ID NO: 369920 - DNA, 249 bp, Homo sapiens
tgacccagcccccacccccacagggagctgtggcacgagatcaatggactcttggtgggcttcggccagcagacctgtctgcctgtgcaccctcgctgccacgcctgcctcaaccaagccctctgcccggccgcccagggtctctgatggccgcatggctctggccgaggtgccgctgtggccaccgtctgtgaagtggctttacgcttcaggaagccacgcctgttgaataaagctttggtgtgtttg

SEQ ID NO: 369921 - DNA, 1693 bp, Homo sapiens
ggccgcatgggccgccgggatgtgtagtccgcaggagtccggcatgaccgccttgagcgcgaggatgctgacccggagccggagcctgggacccggggctgggccgcgggggtgtagggaggagcccgggcctctccggagaagagaggctgcagcagaagcgaggaaaagccacagccccgtgaagcgtccgcggaaagcacagagactgcgtgtggcctatgagggctcggacagtgagaaaggtgagggggctgagcccctcaaggtgccagtctgggagccccaggactggcagcaacagctggtcaacatccgtgccatgaggaacaaaaaggatgcacctgtggaccatctggggactgagcactgctatgactccagtgcccccccaaaggtacgcaggtaccaggtgctgctgtcactgatgctctccagccaaaccaaagaccaggtgacggcgggcgccatgcagcgactgcgggcgcggggcctgacggtggacagcatcctgcagacagatgatgccacgctgggcaagctcatctaccccgtcggtttctggaggagcaaggtgaaatacatcaagcagaccagcgccatcctgcagcagcactacggtggggacatcccagcctctgtggccgagctggtggcgctgccgggtgttgggcccaagatggcacacctggctatggctgtggcctggggcactgtgtcaggcattgcagtggacacgcatgtgcacagaatcgccaacaggctgaggtggaccaagaaggcaaccaagtccccagaggagacccgcgccgccctggaggagtggctgcctagggagctgtggcacgagatcaatggactcttggtgggcttcggccagcagacctgtctgcctgtgcaccctcgctgccacgcctgcctcaaccaagccctctgcccggccgcccagggtctctgatggccgcatggctctggccgaggtgccgctgtggccaccgtctgtgaagtggctttacgcttcaggaagccacgcctgttgaataaagctttggtgtgtttgcaaaaaaaaaaaaaaaagaagcatgagagacagacacataagccacgaagaaaaaaacaaacccggaggtgagagagaaacaagacaagacaaagcggtgacagaaacacgaagaaacacaaaaaacagcgtggaagaaagcgacacaccaacgaaggggatgacgaaaccaatgcaaccacaagatgagagagaaaagcacatcataacaccaaacacgcacacgacacaacaaaccagcgcacgaagaggaaaatagatcgaatcacccccccacgggagaagggcaactcaacgtgagagagaacccaaaaccgaaaggaacgcacacagcgacaatgtaggggatcaaactatgaaaaaacacccaaccccaaaagaagagaaaaaaataaggagaccataggaacgcaaggcccccaccgtagacagagcaaacgaacacaattaccctgaacaagaacccccaccaagaaagacaaagagccccgacaaaagtgcgacagacaaagcgatgcaagtcaaacaataagcaccggagcataaatggcaataaagacacccaagaaagggaacacaacgaagaacagcgaacagcgccgatacaagacagctgaaagtaagaagacgaag

SEQ ID NO: 369922 - DNA, 891 bp, Homo sapiens
ggccgcatgggccgccgggatgtgtagtccgcaggagtccggcatgaccgccttgagcgcgaggatgctgacccggagccggagcctgggacccggggctgggccgcgggggtgtagggaggagcccgggcctctccggagaagagaggctgcagcagaagcgaggaaaagccacagccccgtgaagcgtccgcggaaagcacagagactgcgtgtggcctatgagggctcggacagtgagaaaggtgagggggctgagcccctcaaggtgccagtctgggagccccaggactggcagcaacagctggtcaacatccgtgccatgaggaacaaaaaggatgcacctgtggaccatctggggactgagcactgctatgactccagtgcccccccaaagagcaaggtgaaatacatcaagcagaccagcgccatcctgcagcagcactacggtggggacatcccagcctctgtggccgagctggtggcgctgccgggtgttgggcccaagatggcacacctggctatggctgtggcctggggcactgtgtcaggcattgcagtggacacgcatgtgcacagaatcgccaacaggctgaggtggaccaagaaggcaaccaagtccccagaggagacccgcgccgccctggaggagtggctgcctagggagctgtggcacgagatcaatggactcttggtgggcttcggccagcagacctgtctgcctgtgcaccctcgctgccacgcctgcctcaaccaagccctctgcccggccgcccagggtctctgatggccgcatggctctggccgaggtgccgctgtggccaccgtctgtgaagtggctttacgcttcaggaagccacgcctgttgaataaagctttggtgtgtttgca

SEQ ID NO: 369923 - DNA, 638 bp, Homo sapiens
cgcgcccggccggccaggattttttaaaagggagtgacacaacctgatgtgggtgttagcagactgtctctggtgcagtatagaagatgtattgggggcaccttggtacaggctgttgctagagtcctcatgagctaacatggaccttgtcagggtcgctggcataaggagggcccacataccccagactgcagagggcagagcaccccaagtgtattagatgatggacagttgtggcatgaacgagtgaggggtgagctagcaggcgggatggcacccctaccctaccttcacctgtggccccaccagagggactgcgtggtgctttttgcagaagcgaggaaaagccacagccccgtgaagcgtccgcggaaagcacagagactgcgtgtggcctatgagggctcggacagtgagaaaggtgagggggctgagcccctcaaggtgccagtctgggagccccaggactggcagcaacagctggtcaacatccgtgccatgaggaacaaaaaggatgcacctgtggaccatctggggactgagcactgctatgactccagtgcccccccaaaggtaggcaggggccccatctgcccagatgacccccatcttagcaaggtccttgttttctttctacc

SEQ ID NO: 369924 - DNA, 302 bp, Homo sapiens
acaaccataaagcactgtactaagctcctgacacacattatcccttttaatcctcagaatatcttaggtgtagccactattaatatcccagtttttcaaatgaggaaactgacacccagaaaggctaagtcatttgtccaacatgacacactggaagggctgcagctagtatctgaaccccagtagtcttactgccccaacagtcttgctgcggaggagggaaggggcataccaataacaatgatgataatggtgatgatcatgctaaataacagcaactaacccccattagagttgtacat

SEQ ID NO: 369925 - DNA, 763 bp, Homo sapiens
tgattacagtaatgctgctttttaatatccctcatgatttgacaccttgtcagggttactttggaatactgtcgaagtcttaggcagggtaaacacctttgtagattgagctagctctgtacttaattaaagctaacactttgatcagatcagtgtcagaagattacttctccattgccttcagaaatactctagtaactctttccttactgcttcacagcctcccctggtgaagacacaaactgtcaccatctcagataatgccaatgctgtgaaaagtgaaatcccaaccaaagacgtccctattgtccacactgagaccaagaccatcacttatgaggctgcccagactgacgacaacagtggagacttggacccaggagtcttgctgacagctcaaactatcacatctgagaccccaagcagcaccaccacaactcaaattaccaaggtaacagaccagctagaacctctttatggaacccaggggcaggctaagcttgctgccacctctctgcaagaaggaccctagtccataagcaaatattttcagctccatccctagtaagccacattattcaaagagtcctggatggaaaggccctgctgccttccccagcaataaatctagggagataccctgagagtatccctgcctacttagtagtctcctaaaggtaggtgtggttgttctctttacacatctgtctctctggtcagtgagtcccctgtctggctgtggaagtaagtttaaaaagtcagc

SEQ ID NO: 369926 - DNA, 675 bp, Homo sapiens
ttttgctgggataggcaaagtcttttgggacacgagttcttcaaaggtggtggaagatgaacaaaaccatcctcggggctgaaaagtgagggcttctgaactatgcaattgcagagggactttctttccaagtacggcattcccgatataccagaaaggggtggaagaatgtcagaagaatggcaagcatgaacatcacattcacctgcagggagagcagaagtgaggtgaaatccaggaattctgaacaacagaactgttgctcaatgaagcaagcactggtccattccatgaccaatgaagggaccagaagtctaccgagtttatattctacttttcacccagacactatggtgccctggaggaaggactttcagttacttttcattctgcactatcggttggggtagaggaggaatatcaagcccatttcacagataaagaaacagaggcctagcgagcattcaatgacatgttcaaggtcacatgggaagctggtagaggcaccagctagaatacacagctgattactaggtcacctgatgcaataatcaagtctgctgttttggcctttcgtagtagaagtggttgtagtgtttagatatctgtttggtcttgcttcttgtattgcatttttttcaataaacaacaacaaaaagaactctctctgtgagg

SEQ ID NO: 369927 - DNA, 5986 bp, Homo sapiens
  misc_feature (694)..(694): n is a, c, g, or t
cagtgcaggtggaggccccggcggggcaaagtggcaggaacctcttaaagggcgagacgggcggcgaccgagaacgcggtcggcccggtccccgccgcacccagcccagtcatgacaacagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctcaccattacaattaagaattatttttagagtcttcttatttctgaagcatgtgaatattatctcgatcgttaaaagtcctgctcaggaagaactcagagaagatccagattntgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagaaacatgctaagggacaagatttgcttaaacgagtatgtgagcatctcaatcttttggaagaagactattttggtctagccatttgggataacgcaacctctaagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaaggtggaaaaaacccacatcgaggtgacagtacccacctcaaatggtgaccaaacacagaaaaagagagaaagactagatggtgaaaacatttatatcagacatagcaatttaatgttggaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgacgacaacagtggagacttggacccaggagtcttgctgacagctcaaactatcacatctgagaccccaagcagcaccaccacaactcaaattaccaagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctagcctctctgcccatttatttccaaccccaacagacactgacagggtccacggaattcttcgggaaatcctccaaggactcttgtcagctgtgttggaggccaaagccagcttagtgggacttccgcgtctctccctagtcttatcccctttggatgatggcagaaacttcatgaaccagccctttctcagagccagtgatgtgagtgtatcagaatgccagggagggcaccagccctgatccacagacctcggaaagatgcccctgttcctttgttgcgggtggttttggtaaggcagagccctctgctgagaatgtagtattgtttttcccctctccctcctgctttctttttggagcttctttgggtcaaagacatggaagttgcttcagatatctgatactgtgaatgtttgaacatatccgtggccttcacctctccagctacccttttacctcatcagaagcagtggctcagctaagtgctccccctagctcccatctcaggagaccaaatctcacagaaaaataggcactttgggccaaaagctctaatggaacatttttagtggtgatttggggaaggaaagttaatgaggtttttaaaataaggttttctagttttgagagtgtgcacttcacacaggggaatggggttacttctgtctgatcctgggcctttctttcatcccaaatgacaaggaatgtggctcagagaagggtttttcttttttgacctttcttctctcaacaggaacctgcctgaggacacccttctagagcaaggaattgacttttaggagccgttctccccacaagacaccacatgacaaggggtataagccccagccctgctcattcccactcaccagctgaggtctgtcaggttttgaaggcttgattttgtggtgggtttggggcttagttttcctttttttcattttgatttttgaaagtgaagatgatgccctaattcctggtaaggatttggggcatagttttttgtttttttgagacggagtttcgctcttgttgcccaagctggagtgcagtggcgcgatctcggctcactgcaacctccgcctcctgggttcaagcagttctcttgcctcagcctcccaagtagctgggatgacaggcgcacaccaccacgcccagcaaattttttgtatttttagtagaaacgggatttcaccttgttaggctggtctcgaactcctgacctcaggtgatccacccaccttggcctcccaaagtgctgggattacaggtgtgagccaccacgcccggccgatttggggcatttttatttaacagaacttctctaaccttccaactgcttcccacaaacacattggcctcaaggctccttagaatcccagttccagcttcctaaaatagacagtgggtatcgggcagcagtcactggggctcaagggcagtgagcaagagaaatgtctaaagctgcttctcccaacaccgtccaaagtctccactgcctgagttttgtttcggctggtttgaactcatttcgggtgtgtgcatttttcttttggtacccatgtgagacatgaacaacaggagggagggaaagagcccaggtgggacgtgggacaggcttaggggaaagagcttgtcctatctcaggaacaaaattataggctgtgggcagagggtctgaaaggtgggctttggggtagtgcccaagcctggtcgtgttgccaggagtggtgacaagaaatgcagcttacatcaaacgaacatgtagtgcatgcccactgcctgatggccagatggcctgtaggaagagctaccagggcttccagacctgtggaacgaagaggatggggaaaaggcagagggcactgagtgtccctttaaaaactaacacactgaatattccgtgtgatctagaacagtgtggcagctttcacagcacaggaccgttcatcgggggcctaaacgtttccctcagctctgtcaccaactcacttctctcggcttcgttgtctgtaaattggatgaaaagagctctaatgcctttcaggctcttagaagccatagatttggacaagcccagcaagatgggtgtccttccaggcctcttcccctttcctccatctctggcaacagttcttggggtttggcaattgtttggattttttttctttctgcagttgtgtgtatgtgtgtttgtgtgaagaaaaacagactctgtccaggtagaaatggtgaggagggggaagagaattacatttccagggtcagaaacttggcaacagttttcctagagtgactcagacacaccacagtaacaactctcgctgcaattttattttaatttgagaaataaagatttcctccaagccacatgaggactctggcacccacccacaaagcaagacctgtatttataagccgagggctcagggagcctaactgcgggacccgtcagggccccgtgacccatccccgtccccacccccccctccaccgctgggcccatcagtgtgtgttggggggatgcttggcagctgggggtgaggagacaacaaacctcgggaactggagccagagctgcggcctgactgacgccttttgatgctcacgggaaatttctgcccaggatctcagccccaggctggttgtttctacaaatctctctcaaatgtattattttggtgacaaaaatgaaggagctttgtaaatttttttaaaattatgaatcatatcaagtagttgtttacatttcttgaaaaaataggaactcgggcagcagaatcagattggcagaatctttagactacacaggcaataatcaagtctgctgttttggcctttcgtagtagaagtggttgtagtgtttagatatctgtttggtcttgcttcttgtattgcatttttttcaataaacaacaacaaaaagaactctctctgtgagg

SEQ ID NO: 369928 - DNA, 6031 bp, Homo sapiens
  misc_feature (697)..(697): n is a, c, g, or t
ggcgggagggcgcgcgccagggtcgctcgctcgctccctccctccgctggtgcgtttagtcagtcagccagcagcagccggcgggcccgcgagccgcagagggcccgagcctcggacgccggcgcctcctcctgccattgttcgtcgggctgcagcagtggcgggcgcaggagcccggccccggagccaccgtcatgacaacagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctgctcaggaagaactcagagaagatccagattntgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagaaacatgctaagggacaagatttgcttaaacgagtatgtgagcatctcaatcttttggaagaagactattttggtctagccatttgggataacgcaacctctaagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaaggtggaaaaaacccacatcgaggtgacagtacccacctcaaatggtgaccaaacacagaagcttgcagaaaaaactgaagatctgataagaatgaggaagaaaaagagagaaagactagatggtgaaaacatttatatcagacatagcaatttaatgttggaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgacgacaacagtggagacttggacccaggagtcttgctgacagctcaaactatcacatctgagaccccaagcagcaccaccacaactcaaattaccaagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctagcctctctgcccatttatttccaaccccaacagacactgacagggtccacggaattcttcgggaaatcctccaaggactcttgtcagctgtgttggaggccaaagccagcttagtgggacttccgcgtctctccctagtcttatcccctttggatgatggcagaaacttcatgaaccagccctttctcagagccagtgatgtgagtgtatcagaatgccagggagggcaccagccctgatccacagacctcggaaagatgcccctgttcctttgttgcgggtggttttggtaaggcagagccctctgctgagaatgtagtattgtttttcccctctccctcctgctttctttttggagcttctttgggtcaaagacatggaagttgcttcagatatctgatactgtgaatgtttgaacatatccgtggccttcacctctccagctacccttttacctcatcagaagcagtggctcagctaagtgctccccctagctcccatctcaggagaccaaatctcacagaaaaataggcactttgggccaaaagctctaatggaacatttttagtggtgatttggggaaggaaagttaatgaggtttttaaaataaggttttctagttttgagagtgtgcacttcacacaggggaatggggttacttctgtctgatcctgggcctttctttcatcccaaatgacaaggaatgtggctcagagaagggtttttcttttttgacctttcttctctcaacaggaacctgcctgaggacacccttctagagcaaggaattgacttttaggagccgttctccccacaagacaccacatgacaaggggtataagccccagccctgctcattcccactcaccagctgaggtctgtcaggttttgaaggcttgattttgtggtgggtttggggcttagttttcctttttttcattttgatttttgaaagtgaagatgatgccctaattcctggtaaggatttggggcatagttttttgtttttttgagacggagtttcgctcttgttgcccaagctggagtgcagtggcgcgatctcggctcactgcaacctccgcctcctgggttcaagcagttctcttgcctcagcctcccaagtagctgggatgacaggcgcacaccaccacgcccagcaaattttttgtatttttagtagaaacgggatttcaccttgttaggctggtctcgaactcctgacctcaggtgatccacccaccttggcctcccaaagtgctgggattacaggtgtgagccaccacgcccggccgatttggggcatttttatttaacagaacttctctaaccttccaactgcttcccacaaacacattggcctcaaggctccttagaatcccagttccagcttcctaaaatagacagtgggtatcgggcagcagtcactggggctcaagggcagtgagcaagagaaatgtctaaagctgcttctcccaacaccgtccaaagtctccactgcctgagttttgtttcggctggtttgaactcatttcgggtgtgtgcatttttcttttggtacccatgtgagacatgaacaacaggagggagggaaagagcccaggtgggacgtgggacaggcttaggggaaagagcttgtcctatctcaggaacaaaattataggctgtgggcagagggtctgaaaggtgggctttggggtagtgcccaagcctggtcgtgttgccaggagtggtgacaagaaatgcagcttacatcaaacgaacatgtagtgcatgcccactgcctgatggccagatggcctgtaggaagagctaccagggcttccagacctgtggaacgaagaggatggggaaaaggcagagggcactgagtgtccctttaaaaactaacacactgaatattccgtgtgatctagaacagtgtggcagctttcacagcacaggaccgttcatcgggggcctaaacgtttccctcagctctgtcaccaactcacttctctcggcttcgttgtctgtaaattggatgaaaagagctctaatgcctttcaggctcttagaagccatagatttggacaagcccagcaagatgggtgtccttccaggcctcttcccctttcctccatctctggcaacagttcttggggtttggcaattgtttggattttttttctttctgcagttgtgtgtatgtgtgtttgtgtgaagaaaaacagactctgtccaggtagaaatggtgaggagggggaagagaattacatttccagggtcagaaacttggcaacagttttcctagagtgactcagacacaccacagtaacaactctcgctgcaattttattttaatttgagaaataaagatttcctccaagccacatgaggactctggcacccacccacaaagcaagacctgtatttataagccgagggctcagggagcctaactgcgggacccgtcagggccccgtgacccatccccgtccccacccccccctccaccgctgggcccatcagtgtgtgttggggggatgcttggcagctgggggtgaggagacaacaaacctcgggaactggagccagagctgcggcctgactgacgccttttgatgctcacgggaaatttctgcccaggatctcagccccaggctggttgtttctacaaatctctctcaaatgtattattttggtgacaaaaatgaaggagctttgtaaatttttttaaaattatgaatcatatcaagtagttgtttacatttcttgaaaaaataggaactcgggcagcagaatcagattggcagaatctttagactacacaggcaataatcaagtctgctgttttggcctttcgtagtagaagtggttgtagtgtttagatatctgtttggtcttgcttcttgtattgcatttttttcaataaacaacaacaaaaagaactctctctgtgagg

SEQ ID NO: 369929 - DNA, 5821 bp, Homo sapiens
  misc_feature (697)..(697): n is a, c, g, or t
ggcgggagggcgcgcgccagggtcgctcgctcgctccctccctccgctggtgcgtttagtcagtcagccagcagcagccggcgggcccgcgagccgcagagggcccgagcctcggacgccggcgcctcctcctgccattgttcgtcgggctgcagcagtggcgggcgcaggagcccggccccggagccaccgtcatgacaacagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctgctcaggaagaactcagagaagatccagattntgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaaggtggaaaaaacccacatcgaggtgacagtacccacctcaaatggtgaccaaacacaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgacgacaacagtggagacttggacccaggagtcttgctgacagctcaaactatcacatctgagaccccaagcagcaccaccacaactcaaattaccaagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctagcctctctgcccatttatttccaaccccaacagacactgacagggtccacggaattcttcgggaaatcctccaaggactcttgtcagctgtgttggaggccaaagccagcttagtgggacttccgcgtctctccctagtcttatcccctttggatgatggcagaaacttcatgaaccagccctttctcagagccagtgatgtgagtgtatcagaatgccagggagggcaccagccctgatccacagacctcggaaagatgcccctgttcctttgttgcgggtggttttggtaaggcagagccctctgctgagaatgtagtattgtttttcccctctccctcctgctttctttttggagcttctttgggtcaaagacatggaagttgcttcagatatctgatactgtgaatgtttgaacatatccgtggccttcacctctccagctacccttttacctcatcagaagcagtggctcagctaagtgctccccctagctcccatctcaggagaccaaatctcacagaaaaataggcactttgggccaaaagctctaatggaacatttttagtggtgatttggggaaggaaagttaatgaggtttttaaaataaggttttctagttttgagagtgtgcacttcacacaggggaatggggttacttctgtctgatcctgggcctttctttcatcccaaatgacaaggaatgtggctcagagaagggtttttcttttttgacctttcttctctcaacaggaacctgcctgaggacacccttctagagcaaggaattgacttttaggagccgttctccccacaagacaccacatgacaaggggtataagccccagccctgctcattcccactcaccagctgaggtctgtcaggttttgaaggcttgattttgtggtgggtttggggcttagttttcctttttttcattttgatttttgaaagtgaagatgatgccctaattcctggtaaggatttggggcatagttttttgtttttttgagacggagtttcgctcttgttgcccaagctggagtgcagtggcgcgatctcggctcactgcaacctccgcctcctgggttcaagcagttctcttgcctcagcctcccaagtagctgggatgacaggcgcacaccaccacgcccagcaaattttttgtatttttagtagaaacgggatttcaccttgttaggctggtctcgaactcctgacctcaggtgatccacccaccttggcctcccaaagtgctgggattacaggtgtgagccaccacgcccggccgatttggggcatttttatttaacagaacttctctaaccttccaactgcttcccacaaacacattggcctcaaggctccttagaatcccagttccagcttcctaaaatagacagtgggtatcgggcagcagtcactggggctcaagggcagtgagcaagagaaatgtctaaagctgcttctcccaacaccgtccaaagtctccactgcctgagttttgtttcggctggtttgaactcatttcgggtgtgtgcatttttcttttggtacccatgtgagacatgaacaacaggagggagggaaagagcccaggtgggacgtgggacaggcttaggggaaagagcttgtcctatctcaggaacaaaattataggctgtgggcagagggtctgaaaggtgggctttggggtagtgcccaagcctggtcgtgttgccaggagtggtgacaagaaatgcagcttacatcaaacgaacatgtagtgcatgcccactgcctgatggccagatggcctgtaggaagagctaccagggcttccagacctgtggaacgaagaggatggggaaaaggcagagggcactgagtgtccctttaaaaactaacacactgaatattccgtgtgatctagaacagtgtggcagctttcacagcacaggaccgttcatcgggggcctaaacgtttccctcagctctgtcaccaactcacttctctcggcttcgttgtctgtaaattggatgaaaagagctctaatgcctttcaggctcttagaagccatagatttggacaagcccagcaagatgggtgtccttccaggcctcttcccctttcctccatctctggcaacagttcttggggtttggcaattgtttggattttttttctttctgcagttgtgtgtatgtgtgtttgtgtgaagaaaaacagactctgtccaggtagaaatggtgaggagggggaagagaattacatttccagggtcagaaacttggcaacagttttcctagagtgactcagacacaccacagtaacaactctcgctgcaattttattttaatttgagaaataaagatttcctccaagccacatgaggactctggcacccacccacaaagcaagacctgtatttataagccgagggctcagggagcctaactgcgggacccgtcagggccccgtgacccatccccgtccccacccccccctccaccgctgggcccatcagtgtgtgttggggggatgcttggcagctgggggtgaggagacaacaaacctcgggaactggagccagagctgcggcctgactgacgccttttgatgctcacgggaaatttctgcccaggatctcagccccaggctggttgtttctacaaatctctctcaaatgtattattttggtgacaaaaatgaaggagctttgtaaatttttttaaaattatgaatcatatcaagtagttgtttacatttcttgaaaaaataggaactcgggcagcagaatcagattggcagaatctttagactacacaggcaataatcaagtctgctgttttggcctttcgtagtagaagtggttgtagtgtttagatatctgtttggtcttgcttcttgtattgcatttttttcaataaacaacaacaaaaagaactctctctgtgagg

SEQ ID NO: 369930 - DNA, 3997 bp, Homo sapiens
tgcctgccgggcggattttagagaatcccctgtttgcggccggtggggtttgtggggttcactgccggagtccatcatgtagccagtatacatagagtcatgccaaaaagagagaaagactagatggtgaaaacatttatatcagacatagcaatttaatgttggaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgacgacaacagtggagacttggacccaggagtcttgctgacagctcaaactatcacatctgagaccccaagcagcaccaccacaactcaaattaccaagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctagcctctctgcccatttatttccaaccccaacagacactgacagggtccacggaattcttcgggaaatcctccaaggactcttgtcagctgtgttggaggccaaagccagcttagtgggacttccgcgtctctccctagtcttatcccctttggatgatggcagaaacttcatgaaccagccctttctcagagccagtgatgtgagtgtatcagaatgccagggagggcaccagccctgatccacagacctcggaaagatgcccctgttcctttgttgcgggtggttttggtaaggcagagccctctgctgagaatgtagtattgtttttcccctctccctcctgctttctttttggagcttctttgggtcaaagacatggaagttgcttcagatatctgatactgtgaatgtttgaacatatccgtggccttcacctctccagctacccttttacctcatcagaagcagtggctcagctaagtgctccccctagctcccatctcaggagaccaaatctcacagaaaaataggcactttgggccaaaagctctaatggaacatttttagtggtgatttggggaaggaaagttaatgaggtttttaaaataaggttttctagttttgagagtgtgcacttcacacaggggaatggggttacttctgtctgatcctgggcctttctttcatcccaaatgacaaggaatgtggctcagagaagggtttttcttttttgacctttcttctctcaacaggaacctgcctgaggacacccttctagagcaaggaattgacttttaggagccgttctccccacaagacaccacatgacaaggggtataagccccagccctgctcattcccactcaccagctgaggtctgtcaggttttgaaggcttgattttgtggtgggtttggggcttagttttcctttttttcattttgatttttgaaagtgaagatgatgccctaattcctggtaaggatttggggcatagttttttgtttttttgagacggagtttcgctcttgttgcccaagctggagtgcagtggcgcgatctcggctcactgcaacctccgcctcctgggttcaagcagttctcttgcctcagcctcccaagtagctgggatgacaggcgcacaccaccacgcccagcaaattttttgtatttttagtagaaacgggatttcaccttgttaggctggtctcgaactcctgacctcaggtgatccacccaccttggcctcccaaagtgctgggattacaggtgtgagccaccacgcccggccgatttggggcatttttatttaacagaacttctctaaccttccaactgcttcccacaaacacattggcctcaaggctccttagaatcccagttccagcttcctaaaatagacagtgggtatcgggcagcagtcactggggctcaagggcagtgagcaagagaaatgtctaaagctgcttctcccaacaccgtccaaagtctccactgcctgagttttgtttcggctggtttgaactcatttcgggtgtgtgcatttttcttttggtacccatgtgagacatgaacaacaggagggagggaaagagcccaggtgggacgtgggacaggcttaggggaaagagcttgtcctatctcaggaacaaaattataggctgtgggcagagggtctgaaaggtgggctttggggtagtgcccaagcctggtcgtgttgccaggagtggtgacaagaaatgcagcttacatcaaacgaacatgtagtgcatgcccactgcctgatggccagatggcctgtaggaagagctaccagggcttccagacctgtggaacgaagaggatggggaaaaggcagagggcactgagtgtccctttaaaaactaacacactgaatattccgtgtgatctagaacagtgtggcagctttcacagcacaggaccgttcatcgggggcctaaacgtttccctcagctctgtcaccaactcacttctctcggcttcgttgtctgtaaattggatgaaaagagctctaatgcctttcaggctcttagaagccatagatttggacaagcccagcaagatgggtgtccttccaggcctcttcccctttcctccatctctggcaacagttcttggggtttggcaattgtttggattttttttctttctgcagttgtgtgtatgtgtgtttgtgtgaagaaaaacagactctgtccaggtagaaatggtgaggagggggaagagaattacatttccagggtcagaaacttggcaacagttttcctagagtgactcagacacaccacagtaacaactctcgctgcaattttattttaatttgagaaataaagatttcctccaagccacatgaggactctggcacccacccacaaagcaagacctgtatttataagccgagggctcagggagcctaactgcgggacccgtcagggccccgtgacccatccccgtccccacccccccctccaccgctgggcccatcagtgtgtgttggggggatgcttggcagctgggggtgaggagacaacaaacctcgggaactggagccagagctgcggcctgactgacgccttttgatgctcacgggaaatttctgcccaggatctcagccccaggctggttgtttctacaaatctctctcaaatgtattattttggtgacaaaaatgaaggagctttgtaaatttttttaaaattatgaatcatatcaagtagttgtttacatttcttgaaaaaataggaactcgggcagcagaatcagattggcagaatctttagactacacaggcaataatcaagtctgctgttttggcctttcgtagtagaagtggttgtagtgtttagatatctgtttggtcttgcttcttgtattgcatttttttcaataaacaacaacaaaaagaactctctctgtgagg

SEQ ID NO: 369931 - DNA, 3790 bp, Homo sapiens
  misc_feature (185)..(185): n is a, c, g, or t
cctcagatcgcatgagacttattcactatcactagaacagcacaggaaagacctgcccccatgattcaattacctcccacctgtccctcctacaacactgggaattcaagatgagatttagggggacacagccaaaccatatcattctgccccagtccctcccaaatctcatgtcctcacatttnaaaaccagtcatgccttcccaaccaaagacgtccctattgtccacactgagaccaagaccatcacttatgaggctgcccagactgacgacaacagtggagacttggacccaggagtcttgctgacagctcaaactatcacatctgagaccccaagcagcaccaccacaactcaaattaccaagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctagcctctctgcccatttatttccaaccccaacagacactgacagggtccacggaattcttcgggaaatcctccaaggactcttgtcagctgtgttggaggccaaagccagcttagtgggacttccgcgtctctccctagtcttatcccctttggatgatggcagaaacttcatgaaccagccctttctcagagccagtgatgtgagtgtatcagaatgccagggagggcaccagccctgatccacagacctcggaaagatgcccctgttcctttgttgcgggtggttttggtaaggcagagccctctgctgagaatgtagtattgtttttcccctctccctcctgctttctttttggagcttctttgggtcaaagacatggaagttgcttcagatatctgatactgtgaatgtttgaacatatccgtggccttcacctctccagctacccttttacctcatcagaagcagtggctcagctaagtgctccccctagctcccatctcaggagaccaaatctcacagaaaaataggcactttgggccaaaagctctaatggaacatttttagtggtgatttggggaaggaaagttaatgaggtttttaaaataaggttttctagttttgagagtgtgcacttcacacaggggaatggggttacttctgtctgatcctgggcctttctttcatcccaaatgacaaggaatgtggctcagagaagggtttttcttttttgacctttcttctctcaacaggaacctgcctgaggacacccttctagagcaaggaattgacttttaggagccgttctccccacaagacaccacatgacaaggggtataagccccagccctgctcattcccactcaccagctgaggtctgtcaggttttgaaggcttgattttgtggtgggtttggggcttagttttcctttttttcattttgatttttgaaagtgaagatgatgccctaattcctggtaaggatttggggcatagttttttgtttttttgagacggagtttcgctcttgttgcccaagctggagtgcagtggcgcgatctcggctcactgcaacctccgcctcctgggttcaagcagttctcttgcctcagcctcccaagtagctgggatgacaggcgcacaccaccacgcccagcaaattttttgtatttttagtagaaacgggatttcaccttgttaggctggtctcgaactcctgacctcaggtgatccacccaccttggcctcccaaagtgctgggattacaggtgtgagccaccacgcccggccgatttggggcatttttatttaacagaacttctctaaccttccaactgcttcccacaaacacattggcctcaaggctccttagaatcccagttccagcttcctaaaatagacagtgggtatcgggcagcagtcactggggctcaagggcagtgagcaagagaaatgtctaaagctgcttctcccaacaccgtccaaagtctccactgcctgagttttgtttcggctggtttgaactcatttcgggtgtgtgcatttttcttttggtacccatgtgagacatgaacaacaggagggagggaaagagcccaggtgggacgtgggacaggcttaggggaaagagcttgtcctatctcaggaacaaaattataggctgtgggcagagggtctgaaaggtgggctttggggtagtgcccaagcctggtcgtgttgccaggagtggtgacaagaaatgcagcttacatcaaacgaacatgtagtgcatgcccactgcctgatggccagatggcctgtaggaagagctaccagggcttccagacctgtggaacgaagaggatggggaaaaggcagagggcactgagtgtccctttaaaaactaacacactgaatattccgtgtgatctagaacagtgtggcagctttcacagcacaggaccgttcatcgggggcctaaacgtttccctcagctctgtcaccaactcacttctctcggcttcgttgtctgtaaattggatgaaaagagctctaatgcctttcaggctcttagaagccatagatttggacaagcccagcaagatgggtgtccttccaggcctcttcccctttcctccatctctggcaacagttcttggggtttggcaattgtttggattttttttctttctgcagttgtgtgtatgtgtgtttgtgtgaagaaaaacagactctgtccaggtagaaatggtgaggagggggaagagaattacatttccagggtcagaaacttggcaacagttttcctagagtgactcagacacaccacagtaacaactctcgctgcaattttattttaatttgagaaataaagatttcctccaagccacatgaggactctggcacccacccacaaagcaagacctgtatttataagccgagggctcagggagcctaactgcgggacccgtcagggccccgtgacccatccccgtccccacccccccctccaccgctgggcccatcagtgtgtgttggggggatgcttggcagctgggggtgaggagacaacaaacctcgggaactggagccagagctgcggcctgactgacgccttttgatgctcacgggaaatttctgcccaggatctcagccccaggctggttgtttctacaaatctctctcaaatgtattattttggtgacaaaaatgaaggagctttgtaaatttttttaaaattatgaatcatatcaagtagttgtttacatttcttgaaaaaataggaactcgggcagcagaatcagattggcagaatctttagactacacaggcaataatcaagtctgctgttttggcctttcgtagtagaagtggttgtagtgtttagatatctgtttggtcttgcttcttgtattgcatttttttcaataaacaacaacaaaaagaactctctctgtgagg

SEQ ID NO: 369932 - DNA, 2832 bp, Homo sapiens
  misc_feature (697)..(697): n is a, c, g, or t
ggcgggagggcgcgcgccagggtcgctcgctcgctccctccctccgctggtgcgtttagtcagtcagccagcagcagccggcgggcccgcgagccgcagagggcccgagcctcggacgccggcgcctcctcctgccattgttcgtcgggctgcagcagtggcgggcgcaggagcccggccccggagccaccgtcatgacaacagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctgctcaggaagaactcagagaagatccagattntgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagaaacatgctaagggacaagatttgcttaaacgagtatgtgagcatctcaatcttttggaagaagactattttggtctagccatttgggataacgcaacctctaagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaaggtggaaaaaacccacatcgaggtgacagtacccacctcaaatggtgaccaaacacagaagcttgcagaaaaaactgaagatctgataagaatgaggaagaaaaagagagaaagactagatggtgaaaacatttatatcagacatagcaatttaatgttggaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgacgacaacagtggagacttggacccaggagtcttgctgacagctcaaactatcacatctgagaccccaagcagcaccaccacaactcaaattaccaagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccctctaccccctctagagccaag

SEQ ID NO: 369933 - DNA, 2654 bp, Homo sapiens
  misc_feature (697)..(697): n is a, c, g, or t
ggcgggagggcgcgcgccagggtcgctcgctcgctccctccctccgctggtgcgtttagtcagtcagccagcagcagccggcgggcccgcgagccgcagagggcccgagcctcggacgccggcgcctcctcctgccattgttcgtcgggctgcagcagtggcgggcgcaggagcccggccccggagccaccgtcatgacaacagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctgctcaggaagaactcagagaagatccagattntgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgacgacaacagtggagacttggacccaggagtcttgctgacagctcaaactatcacatctgagaccccaagcagcaccaccacaactcaaattaccaaggtaacagaccagctagaacctctttatggaacccaggggcaggctaagcttgctgccacctctctgcaagaaggaccctagtccataagcaaatattttcagctccatccctagtaagccacattattcaaagagtcctggatggaaaggccctgctgccttccccagcaataaatctagggagataccctgagagtatccctgcctacttagtagtctcctaaaggtaggtgtggttgttctctttacacatctgtctctctggtcagtgagtcccctgtctggctgtggaagtaagtttaaaaagtcagc

SEQ ID NO: 369934 - DNA, 399 bp, Homo sapiens
ttgtgacatagtgttgttaaactaaacacgagttgtgagtttatttgtcccaaaaaatgggaaaacattagtactgtaactcagactattttctgagaatgtcatttattttcagcctcaccattacaattaagaattatttttagagtcttcttatttctgaagcatgtgaatattatctcgatcgttaaaagtgtaagtccttctagaactctgacagtgttggggggaaaaaagtaaaagtcctacatgtttctattataggtctgagatttggactccatagttttattagagtcttattagaatattacatgtatttctagaactattacttgtatattcaaagtgctgagggtaaaatttaggataaaattataattgcacacttgctgttag

SEQ ID NO: 369935 - DNA, 5827 bp, Homo sapiens
  misc_feature (694)..(694): n is a, c, g, or t
cagtgcaggtggaggccccggcggggcaaagtggcaggaacctcttaaagggcgagacgggcggcgaccgagaacgcggtcggcccggtccccgccgcacccagcccagtcatgacaacagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctcaccattacaattaagaattatttttagagtcttcttatttctgaagcatgtgaatattatctcgatcgttaaaagtcctgctcaggaagaactcagagaagatccagattntgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagaaacatgctaagggacaagatttgcttaaacgagtatgtgagcatctcaatcttttggaagaagactattttggtctagccatttgggataacgcaacctctaagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaagaaaaagagagaaagactagatggtgaaaacatttatatcagacatagcaatttaatgttggaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctagcctctctgcccatttatttccaaccccaacagacactgacagggtccacggaattcttcgggaaatcctccaaggactcttgtcagctgtgttggaggccaaagccagcttagtgggacttccgcgtctctccctagtcttatcccctttggatgatggcagaaacttcatgaaccagccctttctcagagccagtgatgtgagtgtatcagaatgccagggagggcaccagccctgatccacagacctcggaaagatgcccctgttcctttgttgcgggtggttttggtaaggcagagccctctgctgagaatgtagtattgtttttcccctctccctcctgctttctttttggagcttctttgggtcaaagacatggaagttgcttcagatatctgatactgtgaatgtttgaacatatccgtggccttcacctctccagctacccttttacctcatcagaagcagtggctcagctaagtgctccccctagctcccatctcaggagaccaaatctcacagaaaaataggcactttgggccaaaagctctaatggaacatttttagtggtgatttggggaaggaaagttaatgaggtttttaaaataaggttttctagttttgagagtgtgcacttcacacaggggaatggggttacttctgtctgatcctgggcctttctttcatcccaaatgacaaggaatgtggctcagagaagggtttttcttttttgacctttcttctctcaacaggaacctgcctgaggacacccttctagagcaaggaattgacttttaggagccgttctccccacaagacaccacatgacaaggggtataagccccagccctgctcattcccactcaccagctgaggtctgtcaggttttgaaggcttgattttgtggtgggtttggggcttagttttcctttttttcattttgatttttgaaagtgaagatgatgccctaattcctggtaaggatttggggcatagttttttgtttttttgagacggagtttcgctcttgttgcccaagctggagtgcagtggcgcgatctcggctcactgcaacctccgcctcctgggttcaagcagttctcttgcctcagcctcccaagtagctgggatgacaggcgcacaccaccacgcccagcaaattttttgtatttttagtagaaacgggatttcaccttgttaggctggtctcgaactcctgacctcaggtgatccacccaccttggcctcccaaagtgctgggattacaggtgtgagccaccacgcccggccgatttggggcatttttatttaacagaacttctctaaccttccaactgcttcccacaaacacattggcctcaaggctccttagaatcccagttccagcttcctaaaatagacagtgggtatcgggcagcagtcactggggctcaagggcagtgagcaagagaaatgtctaaagctgcttctcccaacaccgtccaaagtctccactgcctgagttttgtttcggctggtttgaactcatttcgggtgtgtgcatttttcttttggtacccatgtgagacatgaacaacaggagggagggaaagagcccaggtgggacgtgggacaggcttaggggaaagagcttgtcctatctcaggaacaaaattataggctgtgggcagagggtctgaaaggtgggctttggggtagtgcccaagcctggtcgtgttgccaggagtggtgacaagaaatgcagcttacatcaaacgaacatgtagtgcatgcccactgcctgatggccagatggcctgtaggaagagctaccagggcttccagacctgtggaacgaagaggatggggaaaaggcagagggcactgagtgtccctttaaaaactaacacactgaatattccgtgtgatctagaacagtgtggcagctttcacagcacaggaccgttcatcgggggcctaaacgtttccctcagctctgtcaccaactcacttctctcggcttcgttgtctgtaaattggatgaaaagagctctaatgcctttcaggctcttagaagccatagatttggacaagcccagcaagatgggtgtccttccaggcctcttcccctttcctccatctctggcaacagttcttggggtttggcaattgtttggattttttttctttctgcagttgtgtgtatgtgtgtttgtgtgaagaaaaacagactctgtccaggtagaaatggtgaggagggggaagagaattacatttccagggtcagaaacttggcaacagttttcctagagtgactcagacacaccacagtaacaactctcgctgcaattttattttaatttgagaaataaagatttcctccaagccacatgaggactctggcacccacccacaaagcaagacctgtatttataagccgagggctcagggagcctaactgcgggacccgtcagggccccgtgacccatccccgtccccacccccccctccaccgctgggcccatcagtgtgtgttggggggatgcttggcagctgggggtgaggagacaacaaacctcgggaactggagccagagctgcggcctgactgacgccttttgatgctcacgggaaatttctgcccaggatctcagccccaggctggttgtttctacaaatctctctcaaatgtattattttggtgacaaaaatgaaggagctttgtaaatttttttaaaattatgaatcatatcaagtagttgtttacatttcttgaaaaaataggaactcgggcagcagaatcagattggcagaatctttagactacacaggcaataatcaagtctgctgttttggcctttcgtagtagaagtggttgtagtgtttagatatctgtttggtcttgcttcttgtattgcatttttttcaataaacaacaacaaaaagaactctctctgtgagg

SEQ ID NO: 369936 - DNA, 5681 bp, Homo sapiens
  misc_feature (614)..(614): n is a, c, g, or t
cagtgcaggtggaggccccggcggggcaaagtggcaggaacctcttaaagggcgagacgggcggcgaccgagaacgcggtcggcccggtccccgccgcacccagcccagtcatgacaacagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctgctcaggaagaactcagagaagatccagattntgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgacgacaacagtggagacttggacccaggagtcttgctgacagctcaaactatcacatctgagaccccaagcagcaccaccacaactcaaattaccaagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctagcctctctgcccatttatttccaaccccaacagacactgacagggtccacggaattcttcgggaaatcctccaaggactcttgtcagctgtgttggaggccaaagccagcttagtgggacttccgcgtctctccctagtcttatcccctttggatgatggcagaaacttcatgaaccagccctttctcagagccagtgatgtgagtgtatcagaatgccagggagggcaccagccctgatccacagacctcggaaagatgcccctgttcctttgttgcgggtggttttggtaaggcagagccctctgctgagaatgtagtattgtttttcccctctccctcctgctttctttttggagcttctttgggtcaaagacatggaagttgcttcagatatctgatactgtgaatgtttgaacatatccgtggccttcacctctccagctacccttttacctcatcagaagcagtggctcagctaagtgctccccctagctcccatctcaggagaccaaatctcacagaaaaataggcactttgggccaaaagctctaatggaacatttttagtggtgatttggggaaggaaagttaatgaggtttttaaaataaggttttctagttttgagagtgtgcacttcacacaggggaatggggttacttctgtctgatcctgggcctttctttcatcccaaatgacaaggaatgtggctcagagaagggtttttcttttttgacctttcttctctcaacaggaacctgcctgaggacacccttctagagcaaggaattgacttttaggagccgttctccccacaagacaccacatgacaaggggtataagccccagccctgctcattcccactcaccagctgaggtctgtcaggttttgaaggcttgattttgtggtgggtttggggcttagttttcctttttttcattttgatttttgaaagtgaagatgatgccctaattcctggtaaggatttggggcatagttttttgtttttttgagacggagtttcgctcttgttgcccaagctggagtgcagtggcgcgatctcggctcactgcaacctccgcctcctgggttcaagcagttctcttgcctcagcctcccaagtagctgggatgacaggcgcacaccaccacgcccagcaaattttttgtatttttagtagaaacgggatttcaccttgttaggctggtctcgaactcctgacctcaggtgatccacccaccttggcctcccaaagtgctgggattacaggtgtgagccaccacgcccggccgatttggggcatttttatttaacagaacttctctaaccttccaactgcttcccacaaacacattggcctcaaggctccttagaatcccagttccagcttcctaaaatagacagtgggtatcgggcagcagtcactggggctcaagggcagtgagcaagagaaatgtctaaagctgcttctcccaacaccgtccaaagtctccactgcctgagttttgtttcggctggtttgaactcatttcgggtgtgtgcatttttcttttggtacccatgtgagacatgaacaacaggagggagggaaagagcccaggtgggacgtgggacaggcttaggggaaagagcttgtcctatctcaggaacaaaattataggctgtgggcagagggtctgaaaggtgggctttggggtagtgcccaagcctggtcgtgttgccaggagtggtgacaagaaatgcagcttacatcaaacgaacatgtagtgcatgcccactgcctgatggccagatggcctgtaggaagagctaccagggcttccagacctgtggaacgaagaggatggggaaaaggcagagggcactgagtgtccctttaaaaactaacacactgaatattccgtgtgatctagaacagtgtggcagctttcacagcacaggaccgttcatcgggggcctaaacgtttccctcagctctgtcaccaactcacttctctcggcttcgttgtctgtaaattggatgaaaagagctctaatgcctttcaggctcttagaagccatagatttggacaagcccagcaagatgggtgtccttccaggcctcttcccctttcctccatctctggcaacagttcttggggtttggcaattgtttggattttttttctttctgcagttgtgtgtatgtgtgtttgtgtgaagaaaaacagactctgtccaggtagaaatggtgaggagggggaagagaattacatttccagggtcagaaacttggcaacagttttcctagagtgactcagacacaccacagtaacaactctcgctgcaattttattttaatttgagaaataaagatttcctccaagccacatgaggactctggcacccacccacaaagcaagacctgtatttataagccgagggctcagggagcctaactgcgggacccgtcagggccccgtgacccatccccgtccccacccccccctccaccgctgggcccatcagtgtgtgttggggggatgcttggcagctgggggtgaggagacaacaaacctcgggaactggagccagagctgcggcctgactgacgccttttgatgctcacgggaaatttctgcccaggatctcagccccaggctggttgtttctacaaatctctctcaaatgtattattttggtgacaaaaatgaaggagctttgtaaatttttttaaaattatgaatcatatcaagtagttgtttacatttcttgaaaaaataggaactcgggcagcagaatcagattggcagaatctttagactacacaggcaataatcaagtctgctgttttggcctttcgtagtagaagtggttgtagtgtttagatatctgtttggtcttgcttcttgtattgcatttttttcaataaacaacaacaaaaagaactctctctgtgagg

SEQ ID NO: 369937 - DNA, 5773 bp, Homo sapiens
  misc_feature (694)..(694): n is a, c, g, or t
cagtgcaggtggaggccccggcggggcaaagtggcaggaacctcttaaagggcgagacgggcggcgaccgagaacgcggtcggcccggtccccgccgcacccagcccagtcatgacaacagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctcaccattacaattaagaattatttttagagtcttcttatttctgaagcatgtgaatattatctcgatcgttaaaagtcctgctcaggaagaactcagagaagatccagattntgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagaaacatgctaagggacaagatttgcttaaacgagtatgtgagcatctcaatcttttggaagaagactattttggtctagccatttgggataacgcaacctctaagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaagaaaaagagagaaagactagatggtgaaaacatttatatcagacatagcaatttaatgttggaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctagcctctctgcccatttatttccaaccccaacagacactgacagggtccacggaattcttcgggaaatcctccaaggactcttgtcagctgtgttggaggccaaagccagcttagtgggacttccgcgtctctccctagtcttatcccctttggatgatggcagaaacttcatgaaccagccctttctcagagccagtgatgtgagtgtatcagaatgccagggagggcaccagccctgatccacagacctcggaaagatgcccctgttcctttgttgcgggtggttttggtaaggcagagccctctgctgagaatgtagtattgtttttcccctctccctcctgctttctttttggagcttctttgggtcaaagacatggaagttgcttcagatatctgatactgtgaatgtttgaacatatccgtggccttcacctctccagctacccttttacctcatcagaagcagtggctcagctaagtgctccccctagctcccatctcaggagaccaaatctcacagaaaaataggcactttgggccaaaagctctaatggaacatttttagtggtgatttggggaaggaaagttaatgaggtttttaaaataaggttttctagttttgagagtgtgcacttcacacaggggaatggggttacttctgtctgatcctgggcctttctttcatcccaaatgacaaggaatgtggctcagagaagggtttttcttttttgacctttcttctctcaacaggaacctgcctgaggacacccttctagagcaaggaattgacttttaggagccgttctccccacaagacaccacatgacaaggggtataagccccagccctgctcattcccactcaccagctgaggtctgtcaggttttgaaggcttgattttgtggtgggtttggggcttagttttcctttttttcattttgatttttgaaagtgaagatgatgccctaattcctggtaaggatttggggcatagttttttgtttttttgagacggagtttcgctcttgttgcccaagctggagtgcagtggcgcgatctcggctcactgcaacctccgcctcctgggttcaagcagttctcttgcctcagcctcccaagtagctgggatgacaggcgcacaccaccacgcccagcaaattttttgtatttttagtagaaacgggatttcaccttgttaggctggtctcgaactcctgacctcaggtgatccacccaccttggcctcccaaagtgctgggattacaggtgtgagccaccacgcccggccgatttggggcatttttatttaacagaacttctctaaccttccaactgcttcccacaaacacattggcctcaaggctccttagaatcccagttccagcttcctaaaatagacagtgggtatcgggcagcagtcactggggctcaagggcagtgagcaagagaaatgtctaaagctgcttctcccaacaccgtccaaagtctccactgcctgagttttgtttcggctggtttgaactcatttcgggtgtgtgcatttttcttttggtacccatgtgagacatgaacaacaggagggagggaaagagcccaggtgggacgtgggacaggcttaggggaaagagcttgtcctatctcaggaacaaaattataggctgtgggcagagggtctgaaaggtgggctttggggtagtgcccaagcctggtcgtgttgccaggagtggtgacaagaaatgcagcttacatcaaacgaacatgtagtgcatgcccactgcctgatggccagatggcctgtaggaagagctaccagggcttccagacctgtggaacgaagaggatggggaaaaggcagagggcactgagtgtccctttaaaaactaacacactgaatattccgtgtgatctagaacagtgtggcagctttcacagcacaggaccgttcatcgggggcctaaacgtttccctcagctctgtcaccaactcacttctctcggcttcgttgtctgtaaattggatgaaaagagctctaatgcctttcaggctcttagaagccatagatttggacaagcccagcaagatgggtgtccttccaggcctcttcccctttcctccatctctggcaacagttcttggggtttggcaattgtttggattttttttctttctgcagttgtgtgtatgtgtgtttgtgtgaagaccagggtcagaaacttggcaacagttttcctagagtgactcagacacaccacagtaacaactctcgctgcaattttattttaatttgagaaataaagatttcctccaagccacatgaggactctggcacccacccacaaagcaagacctgtatttataagccgagggctcagggagcctaactgcgggacccgtcagggccccgtgacccatccccgtccccacccccccctccaccgctgggcccatcagtgtgtgttggggggatgcttggcagctgggggtgaggagacaacaaacctcgggaactggagccagagctgcggcctgactgacgccttttgatgctcacgggaaatttctgcccaggatctcagccccaggctggttgtttctacaaatctctctcaaatgtattattttggtgacaaaaatgaaggagctttgtaaatttttttaaaattatgaatcatatcaagtagttgtttacatttcttgaaaaaataggaactcgggcagcagaatcagattggcagaatctttagactacacaggcaataatcaagtctgctgttttggcctttcgtagtagaagtggttgtagtgtttagatatctgtttggtcttgcttcttgtattgcatttttttcaataaacaacaacaaaaagaactctctctgtgagg

SEQ ID NO: 369938 - DNA, 3863 bp, Homo sapiens
tattgttttgcatctttgtcctttcaactgtaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgacgacaacagtggagacttggacccaggagtcttgctgacagctcaaactatcacatctgagaccccaagcagcaccaccacaactcaaattaccaagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctagcctctctgcccatttatttccaaccccaacagacactgacagggtccacggaattcttcgggaaatcctccaaggactcttgtcagctgtgttggaggccaaagccagcttagtgggacttccgcgtctctccctagtcttatcccctttggatgatggcagaaacttcatgaaccagccctttctcagagccagtgatgtgagtgtatcagaatgccagggagggcaccagccctgatccacagacctcggaaagatgcccctgttcctttgttgcgggtggttttggtaaggcagagccctctgctgagaatgtagtattgtttttcccctctccctcctgctttctttttggagcttctttgggtcaaagacatggaagttgcttcagatatctgatactgtgaatgtttgaacatatccgtggccttcacctctccagctacccttttacctcatcagaagcagtggctcagctaagtgctccccctagctcccatctcaggagaccaaatctcacagaaaaataggcactttgggccaaaagctctaatggaacatttttagtggtgatttggggaaggaaagttaatgaggtttttaaaataaggttttctagttttgagagtgtgcacttcacacaggggaatggggttacttctgtctgatcctgggcctttctttcatcccaaatgacaaggaatgtggctcagagaagggtttttcttttttgacctttcttctctcaacaggaacctgcctgaggacacccttctagagcaaggaattgacttttaggagccgttctccccacaagacaccacatgacaaggggtataagccccagccctgctcattcccactcaccagctgaggtctgtcaggttttgaaggcttgattttgtggtgggtttggggcttagttttcctttttttcattttgatttttgaaagtgaagatgatgccctaattcctggtaaggatttggggcatagttttttgtttttttgagacggagtttcgctcttgttgcccaagctggagtgcagtggcgcgatctcggctcactgcaacctccgcctcctgggttcaagcagttctcttgcctcagcctcccaagtagctgggatgacaggcgcacaccaccacgcccagcaaattttttgtatttttagtagaaacgggatttcaccttgttaggctggtctcgaactcctgacctcaggtgatccacccaccttggcctcccaaagtgctgggattacaggtgtgagccaccacgcccggccgatttggggcatttttatttaacagaacttctctaaccttccaactgcttcccacaaacacattggcctcaaggctccttagaatcccagttccagcttcctaaaatagacagtgggtatcgggcagcagtcactggggctcaagggcagtgagcaagagaaatgtctaaagctgcttctcccaacaccgtccaaagtctccactgcctgagttttgtttcggctggtttgaactcatttcgggtgtgtgcatttttcttttggtacccatgtgagacatgaacaacaggagggagggaaagagcccaggtgggacgtgggacaggcttaggggaaagagcttgtcctatctcaggaacaaaattataggctgtgggcagagggtctgaaaggtgggctttggggtagtgcccaagcctggtcgtgttgccaggagtggtgacaagaaatgcagcttacatcaaacgaacatgtagtgcatgcccactgcctgatggccagatggcctgtaggaagagctaccagggcttccagacctgtggaacgaagaggatggggaaaaggcagagggcactgagtgtccctttaaaaactaacacactgaatattccgtgtgatctagaacagtgtggcagctttcacagcacaggaccgttcatcgggggcctaaacgtttccctcagctctgtcaccaactcacttctctcggcttcgttgtctgtaaattggatgaaaagagctctaatgcctttcaggctcttagaagccatagatttggacaagcccagcaagatgggtgtccttccaggcctcttcccctttcctccatctctggcaacagttcttggggtttggcaattgtttggattttttttctttctgcagttgtgtgtatgtgtgtttgtgtgaagaaaaacagactctgtccaggtagaaatggtgaggagggggaagagaattacatttccagggtcagaaacttggcaacagttttcctagagtgactcagacacaccacagtaacaactctcgctgcaattttattttaatttgagaaataaagatttcctccaagccacatgaggactctggcacccacccacaaagcaagacctgtatttataagccgagggctcagggagcctaactgcgggacccgtcagggccccgtgacccatccccgtccccacccccccctccaccgctgggcccatcagtgtgtgttggggggatgcttggcagctgggggtgaggagacaacaaacctcgggaactggagccagagctgcggcctgactgacgccttttgatgctcacgggaaatttctgcccaggatctcagccccaggctggttgtttctacaaatctctctcaaatgtattattttggtgacaaaaatgaaggagctttgtaaatttttttaaaattatgaatcatatcaagtagttgtttacatttcttgaaaaaataggaactcgggcagcagaatcagattggcagaatctttagactacacaggcaataatcaagtctgctgttttggcctttcgtagtagaagtggttgtagtgtttagatatctgtttggtcttgcttcttgtattgcatttttttcaataaacaacaacaaaaagaactctctctgtgagg

SEQ ID NO: 369939 - DNA, 4202 bp, Homo sapiens
  misc_feature (694)..(694): n is a, c, g, or t
cagtgcaggtggaggccccggcggggcaaagtggcaggaacctcttaaagggcgagacgggcggcgaccgagaacgcggtcggcccggtccccgccgcacccagcccagtcatgacaacagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctcaccattacaattaagaattatttttagagtcttcttatttctgaagcatgtgaatattatctcgatcgttaaaagtcctgctcaggaagaactcagagaagatccagattntgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagaaacatgctaagggacaagatttgcttaaacgagtatgtgagcatctcaatcttttggaagaagactattttggtctagccatttgggataacgcaacctctaagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaagaaaaagagagaaagactagatggtgaaaacatttatatcagacatagcaatttaatgttggaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctagcctctctgcccatttatttccaaccccaacagacactgacagggtccacggaattcttcgggaaatcctccaaggactcttgtcagctgtgttggaggccaaagccagcttagtgggacttccgcgtctctccctagtcttatcccctttggatgatggcagaaacttcatgaaccagccctttctcagagccagtgatgtgagtgtatcagaatgccagggagggcaccagccctgatccacagacctcggaaagatgcccctgttcctttgttgcgggtggttttggtaaggcagagccctctgctgagaatgtagtattgtttttcccctctccctcctgctttctttttggagcttctttgggtcaaagacatggaagttgcttcagatatctgatactgtgaatgtttgaacatatccgtggccttcacctctccagctacccttttacctcatcagaagcagtggctcagctaagtgctccccctagctcccatctcaggagaccaaatctcacagaaaaataggcactttgggccaaaagctctaatggaacatttttagtggtgatttggggaaggaaagttaatgaggtttttaaaataaggttttctagttttgagagtgtgcacttcacacaggggaatggggttacttctgtctgatcctgggcctttctttcatcccaaatgacaaggaatgtggctcagagaagggtttttcttttttgacctttcttctctcaacaggaacctgcctgaggacacccttctagagcaaggaattgacttttaggagccgttctccccacaagacaccacatgacaaggggtataagccccagccctgctcattcccactcaccagctgaggtctgtcaggttttgaaggcttgattttgtggtgggtttggggcttagttttcctttttttcattttgatttttgaaagtgaagatgatgccctaattcctggtaaggatttggggcatagttttttgtttttttgagacggagtttcgctcttgttgcccaagctggagtgcagtgagccacagttgcgccattgcactccagctcttgggcaatgagtgaaactcctgtctccaacatatacacacacttccacactcacacctcactcgccgacttcccccctccactccacgctttcggacaacggactattggcacgcagtaccacgagcttatctctccagcaattacttcaacaacttagattggtcccaagcgtgacaggagactcctgtctgccacgatcctatcagatgccaccaagggacccactgtga

SEQ ID NO: 369940 - DNA, 3070 bp, Homo sapiens
  misc_feature (697)..(697): n is a, c, g, or t
ggcgggagggcgcgcgccagggtcgctcgctcgctccctccctccgctggtgcgtttagtcagtcagccagcagcagccggcgggcccgcgagccgcagagggcccgagcctcggacgccggcgcctcctcctgccattgttcgtcgggctgcagcagtggcgggcgcaggagcccggccccggagccaccgtcatgacaacagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctgctcaggaagaactcagagaagatccagattntgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagaaacatgctaagggacaagatttgcttaaacgagtatgtgagcatctcaatcttttggaagaagactattttggtctagccatttgggataacgcaacctctaagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaaggtggaaaaaacccacatcgaggtgacagtacccacctcaaatggtgaccaaacacagaagcttgcagaaaaaactgaagatctgataagaatgaggaagaaaaagagagaaagactagatggtgaaaacatttatatcagacatagcaatttaatgttggaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgacgacaacagtggagacttggacccaggagtcttgctgacagctcaaactatcacatctgagaccccaagcagcaccaccacaactcaaattaccaagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcagggaactaacctaccccaactctgcccttctcccaaacaagaaccaacatagacagctatctgccctacccggctgttctacccagctcagcctgcgggtctttcagtacctggtggggccgcaggggcgggcgcccctgacaccgcactcacgtcccagtgtcaagtcacaaaaggcaagctcatcaagcaaatggttctaggagcccagtccacgaggtgctgacatggtgaggatgagtctacagccatgtgtgtgccggtccgtatcctgag

SEQ ID NO: 369941 - DNA, 613 bp, Homo sapiens
agcacctaattactgctgtccttttcctagacccggcataaaaagaacctggtccggtagacctagcctctcagtatgctaggaacttacactttttagttgcctttaccaagtattgcagatactactgcaaataagtgaagaaagtaacagcatttaactgatttgggaacttggtttgatcttgttctaatgacccacttcgaatggtggttgaaagtaaaatctgtatcgccgtcttatgtttccatttacctagaaatactttacctttgagcacaggaaattaatccccttctggttgttctccccctggcattggttttaaatatataatgattatgtttgttgtaggaaaaatagaaaaacaactacaatagaaaattcttcccatatattattttgaaatacatatttccgatccgataatccattgctctagcatggaaaatgttggatttacttgtgtttgctttttccaaataaaatggaacttttgtggctacattatagaattgttttagactgcttaattctgtgtgttgttgagaaagggaggagtggggaaggtaaaaatcttgacatactttcttcgtgggtattttttcttgag

SEQ ID NO: 369942 - DNA, 1757 bp, Homo sapiens
gttatgcaatcaatgatctgggtttttctcttcagagaaatttgttgtacagaaaattgctgttgggatgaagctttgcagccttgcagtccttgtacccattgttctcttctgtgagcagcatgtcttcgcgtttcagagtggccaagttctagctgctcttcctagaacctctaggcaagttcaagttctacagaatcttactacaacatatgagattgttctctggcagccggtaacagctgaccttattgtgaagaaaaaacaagtccatttttttgtaaatgcatctgatgtcgacaatgtgaaagcccatttaaatgtgagcggaattccatgcagtgtcttgctggcagacgtggaagatcttattcaacagcagatttccaacgacacagtcagcccccgagcctccgcatcgtactatgaacagtatcactcactaaatgaaatctattcttggatagaatttataactgagaggcatcctgatatgcttacaaaaatccacattggatcctcatttgagaagtacccactctatgttttaaaggtttctggaaaagaacaagcagccaaaaatgccatatggattgactgtggaatccatgccagagaatggatctctcctgctttctgcttgtggttcataggccatataactcaattctatgggataatagggcaatataccaatctcctgaggcttgtggatttctatgttatgccggtggttaatgtggatggttatgactactcatggaaaaagaatcgaatgtggagaaagaaccgttctttctatgcgaacaatcattgcatcggaacagacctgaataggaactttgcttccaaacactggtgtgaggaaggtgcatccagttcctcatgctcggaaacctactgtggactttatcctgagtcagaaccagaagtgaaggcagtggctagtttcttgagaagaaatatcaaccagattaaagcatacatcagcatgcattcatactcccagcatatagtgtttccatattcctatacacgaagtaaaagcaaagaccatgaggaactgtctctagtagccagtgaagcagttcgtgctattgagaaaactagtaaaaataccaggtatacacatggccatggctcagaaaccttatacctagctcctggaggtggggacgattggatctatgatttgggcatcaaatattcgtttacaattgaacttcgagatacgggcacatacggattcttgctgccggagcgttacatcaaacccacctgtagagaagcttttgccgctgtctctaaaatagcttggcatgtcattaggaatgtttaatgcccctgattttatcattctgcttccgtattttaatttactgattccagcaagaccaaatcattgtatcagattatttttaagttttatccgtagttttgataaaagattttcctattccttggttctgtcagagaacctaataagtgctactttgccattaaggcagactagggttcatgtctttttaccctttaaaaaaaattgtaaaagtctagttacctactttttctttgattttcgacgtttgactagccatctcaagcaactttcgacgtttgactagccatctcaagcaagtttaatcaatgatcatctcacgctgatcattggatcctactcaacaaaaggaagggtggtcagaagtacattaaagatttctgctccaaattttcaataaatttctgcttgtgccttt

SEQ ID NO: 369943 - DNA, 1594 bp, Homo sapiens
gttatgcaatcaatgatctgggtttttctcttcagagaaatttgttgtacagaaaattgctgttgggatgaagctttgcagccttgcagtccttgtacccattgttctcttctgtgagcagcatgtcttcgcgtttcagagtggccaagttctagctgctcttcctagaacctctaggcaagttcaagttctacagaatcttactacaacatatgagattgttctctggcagccggtaacagctgaccttattgtgaagaaaaaacaagtccatttttttgtaaatgcatctgatgtcgacaatgtgaaagcccatttaaatgtgagcggaattccatgcagtgtcttgctggcagacgtggaagatcttattcaacagcagatttccaacgacacagtcagcccccgagcctccgcatcgtactatgaacagtatcactcactaaatgaaatctattcttggatagaatttataactgagaggcatcctgatatgcttacaaaaatccacattggatcctcatttgagaagtacccactctatgttttaaaggtttctggaaaagaacaagcagccaaaaatgccatatggattgactgtggaatccatgccagagaatggatctctcctgctttctgcttgtggttcataggccataatcgaatgtggagaaagaaccgttctttctatgcgaacaatcattgcatcggaacagacctgaataggaactttgcttccaaacactggtgtgaggaaggtgcatccagttcctcatgctcggaaacctactgtggactttatcctgagtcagaaccagaagtgaaggcagtggctagtttcttgagaagaaatatcaaccagattaaagcatacatcagcatgcattcatactcccagcatatagtgtttccatattcctatacacgaagtaaaagcaaagaccatgaggaactgtctctagtagccagtgaagcagttcgtgctattgagaaaactagtaaaaataccaggtatacacatggccatggctcagaaaccttatacctagctcctggaggtggggacgattggatctatgatttgggcatcaaatattcgtttacatcaaacccacctgtagagaagcttttgccgctgtctctaaaatagcttggcatgtcattaggaatgtttaatgcccctgattttatcattctgcttccgtattttaatttactgattccagcaagaccaaatcattgtatcagattatttttaagttttatccgtagttttgataaaagattttcctattccttggttctgtcagagaacctaataagtgctactttgccattaaggcagactagggttcatgtctttttaccctttaaaaaaaattgtaaaagtctagttacctactttttctttgattttcgacgtttgactagccatctcaagcaactttcgacgtttgactagccatctcaagcaagtttaatcaatgatcatctcacgctgatcattggatcctactcaacaaaaggaagggtggtcagaagtacattaaagatttctgctccaaattttcaataaatttctgcttgtgccttt

SEQ ID NO: 369944 - DNA, 1694 bp, Homo sapiens
gttatgcaatcaatgatctgggtttttctcttcagagaaatttgttgtacagaaaattgctgttgggatgaagctttgcagccttgcagtccttgtacccattgttctcttctgtgagcagcatgtcttcgcgtttcagagtggccaagttctagctgctcttcctagaacctctaggcaagttcaagttctacagaatcttactacaacatatgagattgttctctggcagccggtaacagctgaccttattgtgaagaaaaaacaagtccatttttttgtaaatgcatctgatgtcgacaatgtgaaagcccatttaaatgtgagcggaattccatgcagtgtcttgctggcagacgtggaagatcttattcaacagcagatttccaacgacacagtcagcccccgagcctccgcatcgtactatgaacagtatcactcactaaatgaaatctattcttggatagaatttataactgagaggcatcctgatatgcttacaaaaatccacattggatcctcatttgagaagtacccactctatgttttaaagttctgggaaccagccactttctgcttgtggttcataggccatataactcaattctatgggataatagggcaatataccaatctcctgaggcttgtggatttctatgttatgccggtggttaatgtggatggttatgactactcatggaaaaagaatcgaatgtggagaaagaaccgttctttctatgcgaacaatcattgcatcggaacagacctgaataggaactttgcttccaaacactggtgtgaggaaggtgcatccagttcctcatgctcggaaacctactgtggactttatcctgagtcagaaccagaagtgaaggcagtggctagtttcttgagaagaaatatcaaccagattaaagcatacatcagcatgcattcatactcccagcatatagtgtttccatattcctatacacgaagtaaaagcaaagaccatgaggaactgtctctagtagccagtgaagcagttcgtgctattgagaaaactagtaaaaataccaggtatacacatggccatggctcagaaaccttatacctagctcctggaggtggggacgattggatctatgatttgggcatcaaatattcgtttacaattgaacttcgagatacgggcacatacggattcttgctgccggagcgttacatcaaacccacctgtagagaagcttttgccgctgtctctaaaatagcttggcatgtcattaggaatgtttaatgcccctgattttatcattctgcttccgtattttaatttactgattccagcaagaccaaatcattgtatcagattatttttaagttttatccgtagttttgataaaagattttcctattccttggttctgtcagagaacctaataagtgctactttgccattaaggcagactagggttcatgtctttttaccctttaaaaaaaattgtaaaagtctagttacctactttttctttgattttcgacgtttgactagccatctcaagcaactttcgacgtttgactagccatctcaagcaagtttaatcaatgatcatctcacgctgatcattggatcctactcaacaaaaggaagggtggtcagaagtacattaaagatttctgctccaaattttcaataaatttctgcttgtgccttt

SEQ ID NO: 369945 - DNA, 1698 bp, Homo sapiens
  misc_feature (773)..(773): n is a, c, g, or t
  misc_feature (785)..(785): n is a, c, g, or t
  misc_feature (792)..(792): n is a, c, g, or t
gttatgcaatcaatgatctgggtttttctcttcagagaaatttgttgtacagaaaattgctgttgggatgaagctttgcagccttgcagtccttgtacccattgttctcttctgtgagcagcatgtcttcgcgtttcagagtggccaagttctagctgctcttcctagaacctctaggcaagttcaagttctacagaatcttactacaacatatgagattgttctctggcagccggtaacagctgaccttattgtgaagaaaaaacaagtccatttttttgtaaatgcatctgatgtcgacaatgtgaaagcccatttaaatgtgagcggaattccatgcagtgtcttgctggcagacgtggaagatcttattcaacagcagatttccaacgacacagtcagcccccgagcctccgcatcgtactatgaacagtatcactcactaaatgaaatctattcttggatagaatttataactgagaggcatcctgatatgcttacaaaaatccacattggatcctcatttgagaagtacccactctatgttttaaaggtttctggaaaagaacaagcagccaaaaatgccatatggattgactgtggaatccatgccagagaatggatctctcctgctttctgcttgtggttcataggccatataactcaattctatgggataatagggcaatataccaatctcctgaggcttgtggatttctatgttatgccggtggttaatgtggatggttatgactactcatggaaaaagcagncctgataggacnttgcttncaacactgggtgaggaaggtgcatccagttcctcatgctcggaaacctactgtggactttatcctgagtcagaaccagaagtgaaggcagtggctagtttcttgagaagaaatatcaaccagattaaagcatacatcagcatgcattcatactcccagcatatagtgtttccatattcctatacacgaagtaaaagcaaagaccatgaggaactgtctctagtagccagtgaagcagttcgtgctattgagaaaactagtaaaaataccaggtatacacatggccatggctcagaaaccttatacctagctcctggaggtggggacgattggatctatgatttgggcatcaaatattcgtttacaattgaacttcgagatacgggcacatacggattcttgctgccggagcgttacatcaaacccacctgtagagaagcttttgccgctgtctctaaaatagcttggcatgtcattaggaatgtttaatgcccctgattttatcattctgcttccgtattttaatttactgattccagcaagaccaaatcattgtatcagattatttttaagttttatccgtagttttgataaaagattttcctattccttggttctgtcagagaacctaataagtgctactttgccattaaggcagactagggttcatgtctttttaccctttaaaaaaaattgtaaaagtctagttacctactttttctttgattttcgacgtttgactagccatctcaagcaactttcgacgtttgactagccatctcaagcaagtttaatcaatgatcatctcacgctgatcattggatcctactcaacaaaaggaagggtggtcagaagtacattaaagatttctgctccaaattttcaataaatttctgcttgtgccttt

SEQ ID NO: 369946 - DNA, 1722 bp, Homo sapiens
gttatgcaatcaatgatctgggtttttctcttcagagaaatttgttgtacagaaaattgctgttgggatgaagctttgcagccttgcagtccttgtacccattgtttggccaagttctagctgctcttcctagaacctctaggcaagttcaagttctacagaatcttactacaacatatgagattgttctctggcagccggtaacagctgaccttattgtgaagaaaaaacaagtccatttttttgtaaatgcatctgatgtcgacaatgtgaaagcccatttaaatgtgagcggaattccatgcagtgtcttgctggcagacgtggaagatcttattcaacagcagatttccaacgacacagtcagcccccgagcctccgcatcgtactatgaacagtatcactcactaaatgaaatctattcttggatagaatttataactgagaggcatcctgatatgcttacaaaaatccacattggatcctcatttgagaagtacccactctatgttttaaaggtttctggaaaagaacaagcagccaaaaatgccatatggattgactgtggaatccatgccagagaatggatctctcctgctttctgcttgtggttcataggccatataactcaattctatgggataatagggcaatataccaatctcctgaggcttgtggatttctatgttatgccggtggttaatgtggatggttatgactactcatggaaaaagaatcgaatgtggagaaagaaccgttctttctatgcgaacaatcattgcatcggaacagacctgaataggaactttgcttccaaacactggtgtgaggaaggtgcatccagttcctcatgctcggaaacctactgtggactttatcctgagtcagaaccagaagtgaaggcagtggctagtttcttgagaagaaatatcaaccagattaaagcatacatcagcatgcattcatactcccagcatatagtgtttccatattcctatacacgaagtaaaagcaaagaccatgaggaactgtctctagtagccagtgaagcagttcgtgctattgagaaaactagtaaaaataccaggtatacacatggccatggctcagaaaccttatacctagctcctggaggtggggacgattggatctatgatttgggcatcaaatattcgtttacaattgaacttcgagatacgggcacatacggattcttgctgccggagcgttacatcaaacccacctgtagagaagcttttgccgctgtctctaaaatagcttggcatgtcattaggaatgtttaatgcccctgattttatcattctgcttccgtattttaatttactgattccagcaagaccaaatcattgtatcagattatttttaagttttatccgtagttttgataaaagattttcctattccttggttctgtcagagaacctaataagtgctactttgccattaaggcagactagggttcatgtctttttaccctttaaaaaaaattgtaaaagtctagttacctactttttctttgattttcgacgtttgactagccatctcaagcaactttcgacgtttgactagccatctcaagcaagtttaatcaatgatcatctcacgctgatcattggatcctactcaacaaaaggaagggtggtcagaagtacattaaagatttctgctccaaattttcaataaatttctgcttgtgccttt

SEQ ID NO: 369947 - DNA, 1937 bp, Homo sapiens
gttatgcaatcaatgatctgggtttttctcttcagagaaatttgttgtacagaaaattgctgttgggatgaagctttgcagccttgcagtccttgtacccattgttctcttctgtgagcagcatgtcttcgcgtttcagagtggccaagttctagctgctcttcctagaacctctaggcaagttcaagttctacagaatcttactacaacatatgagattgttctctggcagccggtaacagctgaccttattgtgaagaaaaaacaagtccatttttttgtaaatgcatctgatgtcgacaatgtgaaagcccatttaaatgtgagcggaattccatgcagtgtcttgctggcagacgtggaagatcttattcaacagcagatttccaacgacacagtcagcccccgagcctccgcatcgtactatgaacagtatcactcactaaatgaaatctattcttggatagaatttataactgagaggcatcctgatatgcttacaaaaatccacattggatcctcatttgagaagtacccactctatgttttaaaggtttctggaaaagaacaagcagccaaaaatgccatatggattgactgtggaatccatgccagagaatggatctctcctgctttctgcttgtggttcataggccatataactcaattctatgggataatagggcaatataccaatctcctgaggcttgtggatttctatgttatgccggtggttaatgtggatggttatgactactcatggaaaaagaatcgaatgtggagaaagaaccgttctttctatgcgaacaatcattgcatcggaacagacctgaataggaactttgcttccaaacactggtgtgaggaaggtgcatccagttcctcatgctcggaaacctactgtggactttatcctgagtcagaaccagaagtgaaggcagtggctagtttcttgagaagaaatatcaaccagattaaagcatacatcagcatgcattcatactcccagcatatagtgtttccatattcctatacacgaagtaaaagcaaagaccatgaggaactgtctctagtagccagtgaagcagttcgtgctattgagaaaactagtaaaaataccaggtatacacatggccatggctcagaaaccttatacctagctcctggaggtggggacgattggatctatgatttgggcatcaaatattcgtttacaattgaacttcgagatacgggcacatacggattcttgctgccggagcgttacatcaaacccacctgtagagaagcttttgccgctgtctctgcttccgtattttaatttactgattccagcaagaccaaatcattgtatcagattatttttaagttttatccgtagttttgataaaagattttcctattccttggttctgtcagagaacctaataagtgctactttgccattaaggcagactagggttcatgtctttttaccctttaaaaaaaattgtaaaagtctagttacctactttttctttgattttcgacgtttgactagccatctcaagcaactttcgacgtttgactagccatctcaagcaagtttaatcaatgatcatctcacgctgatcattggatcctactcaacaaaaggaagggtggtcagaagtacattaaagatttctgctccaaattttcaataaatttctgcttgtgcctttagaaatacaaccatgcattccgtttgctccacggtaattaggcgatggcccagaaaggggaggggtgtcaaaaacgacaaacatagcctctcattccagctcagctgctcaataaacactgttgaacgaatgaatgagtggctctaggtactgtcaacaaatgccgcattttgcgcatttacaacagctgtttatggtaaggaattatgtaataaaaagagaaaactcacttaa

SEQ ID NO: 369948 - DNA, 1727 bp, Homo sapiens
gttatgcaatcaatgatctgggtttttctcttcagagaaatttgttgtacagaaaattgctgttgggatgaagctttgcagccttgcagtccttgtacccattgttctcttctgtgagcagcatgtcttcgcgtttcagagtggccaagttctagctgctcttcctagaacctctaggcaagttcaagttctacagaatcttactacaacatatgagattgttctctggcagccggtaacagctgaccttattgtgaagaaaaaacaagtccatttttttgtaaatgcatctgatgtcgacaatgtgaaagcccatttaaatgtgagcggaattccatgcagtgtcttgctggcagacgtggaagatcttattcaacagcagatttccaacgacacagtcagcccccgagcctccgcatcgtactatgaacagtatcactcactaaatgaaatctattcttggatagaatttataactgagaggcatcctgatatgcttacaaaaatccacattggatcctcatttgagaagtacccactctatgttttaaaggtttctggaaaagaacaagcagccaaaaatgccatatggattgactgtggaatccatgccagagaatggatctctcctgctttctgcttgtggttcataggccatataactcaattctatgggataatagggcaatataccaatctcctgaggcttgtggatttctatgttatgccggtggttaatgtggatggttatgactactcatggaaaaagaatcgaatgtggagaaagaaccgttctttctatgcgaacaatcattgcatcggaacagacctgaataggaactttgcttccaaacactggtgtgaggaaggtgcatccagttcctcatgctcggaaacctactgtggactttatcctgagtcagaaccagaagtgaaggcagtggctagtttcttgagaagaaatatcaaccagattaaagcatacatcagcatgcattcatactcccagcatatagtgtttccatattcctatacacgaagtaaaagcaaagaccatgaggaactgtctctagtagccagtgaagcagttcgtgctattgagaaaactagtaaaaataccaggtatacacatggccatggctcagaaaccttatacctagctcctggaggtggggacgattggatctatgatttgggcatcaaatattcgtttacaattgaacttcgagatacgggcacatacggattcttgctgccggagcgttacatcaaacccacctgtagagaagcttttgccgctgtctctaaaatagcttggcatgtcattaggaatgtttaatgcccctgattttatcattctgcttccgtattttaatttactgattccagcaagaccaaatcattgtatcagattatttttaagttttatccgtagttttgataaaagattttcctattccttggttctgtcagagaacctaataagtgctactttgccattaaggcagactagggttcatgtctttttaccctttaaaaaaaattgtaaaagtctagttacctactttttctttgattttcgacgtttgactagccatctcaagcaactttcgacgtttgactagccatctcaagcaagtttaatcaatgatcatctcacgctgatcattggatcctactcaacaaaaggaagggtggtcagaagtacattaaagatttctgctcca

SEQ ID NO: 369949 - DNA, 730 bp, Homo sapiens
gttatgcaatcaatgatctgggtttttctcttcagagaaatttgttgtacagaaaattgctgttgggatgaagctttgcagccttgcagtccttgtacccattgttctcttctgtgagcagcatgtcttcgcgtttcagagtggccaagttctagctgctcttcctagaacctctaggcaagttcaagttctacagaatcttactacaacatatgagattgttctctggcagccggtaacagctgaccttattgtgaagaaaaaacaagtccatttttttgtaaatgcatctgatgtcgacaatgtgaaagcccatttaaatgtgagcggaattccatgcagtgtcttgctggcagacgtggaagatcttattcaacagcagatttccaacgacacagtcagcccccgagcctccgcatcgtactatgaacagtatcactcactaaatgaaatctattcttggatagaatttataactgagaggcatcctgatatgcttacaaaaatccacattggatcctcatttgagaagtacccactctatgttttaaaggtttctggaaaagaacaagcagccaaaaatgccatatggattgactgtggaatccatgccagagaatggatctctcctgctttctgcttgtggttcataggccatgtcacatcatgaagcttgggaatctacaattttcacaagtttcccaggtgacttttatgcattagtaagttg

SEQ ID NO: 369950 - DNA, 1991 bp, Homo sapiens
gttatgcaatcaatgatctgggtttttctcttcagagaaatttgttgtacagaaaattgctgttgggatgaagctttgcagccttgcagtccttgtacccattgttctcttctgtgagcagcatgtcttcgcgtttcagagtggccaagttctagctgctcttcctagaacctctaggcaagttcaagttctacagaatcttactacaacatatgagattgttctctggcagccggtaacagctgaccttattgtgaagaaaaaacaagtccatttttttgtaaatgcatctgatgtcgacaatgtgaaagcccatttaaatgtgagcggaattccatgcagtgtcttgctggcagacgtggaagatcttattcaacagcagatttccaacgacacagtcagcccccgagcctccgcatcgtactatgaacagtatcactcactaaatgaaatctattcttggatagaatttataactgagaggcatcctgatatgcttacaaaaatccacattggatcctcatttgagaagtacccactctatgttttaaaggtttctggaaaagaacaagcagccaaaaatgccatatggattgactgtggaatccatgccagagaatggatctctcctgctttctgcttgtggttcataggccatataactcaattctatgggataatagggcaatataccaatctcctgaggcttgtggatttctatgttatgccggtggttaatgtggatggttatgactactcatggaaaaagaatcgaatgtggagaaagaaccgttctttctatgcgaacaatcattgcatcggaacagacctgaataggaactttgcttccaaacactggtgtgaggaaggtgcatccagttcctcatgctcggaaacctactgtggactttatcctgagtcagaaccagaagtgaaggcagtggctagtttcttgagaagaaatatcaaccagattaaagcatacatcagcatgcattcatactcccagcatatagtgtttccatattcctatacacgaagtaaaagcaaagaccatgaggaactgtctctagtagccagtgaagcagttcgtgctattgagaaaactagtaaaaataccaggtatacacatggccatggctcagaaaccttatacctagctcctggaggtggggacgattggatctatgatttgggcatcaaatattcgtttacaattgaacttcgagatacgggcacatacggattcttgctgccggagcgttacatcaaacccacctgtagagaagcttttgccgctgtctctaaaatagcttggcatgtcattaggaatgtttaatgcccctgattttatcattctgcttccgtattttaatttactgattccagcaagaccaaatcattgtatcagattatttttaagttttatccgtagttttgataaaagattttcctattccttggttctgtcagagaacctaataagtgctactttgccattaaggcagactagggttcatgtctttttaccctttaaaaaaaattgtaaaagtctagttacctactttttctttgattttcgacgtttgactagccatctcaagcaactttcgacgtttgactagccatctcaagcaagtttaatcaatgatcatctcacgctgatcattggatcctactcaacaaaaggaagggtggtcagaagtacattaaagatttctgctccaaattttcaataaatttctgcttgtgcctttagaaatacaaccatgcattccgtttgctccacggtaattaggcgatggcccagaaaggggaggggtgtcaaaaacgacaaacatagcctctcattccagctcagctgctcaataaacactgttgaacgaatgaatgagtggctctaggtactgtcaacaaatgccgcattttgcgcatttacaacagctgtttatggtaaggaattatgtaataaaaagagaaaactcacttaa
